United States Patent 11,732,272 (POLYNUCLEOTIDES AND POLYPEPTIDES OF PLANT AND BACTERIAL ORIGIN FOR PROTECTING PLANTS FROM PATHOGENIC FUNGI) - sequence listing, part 2

SEQ ID NO: 2177 - DNA, 1452 bp, Pseudomonas sp.
atgtcgtcatctattcgtaaatccatcaattcagacgcattgacgcggttggctcaagccatcgcggtggctgtgtccgccactctggcgggctgtcagagcacgagccacgtcccgcaaaccgacgcttcgcatacccagaatttcaacgcccgcatcaagcagaaacccatctggctgagcgagaagcccagcccgcaattgccccaggacgtctgggcgcgcatgcgcgaaggtttccagttgcaggacggcatcggcgtcaacccgcgcatcgagcaacagcgcctgtggttcgccagcaacccctcgtttctcgagaacgccagcgaacgcggcagcctctatatccactacatcgtcgaacgtcttgaagaacgcaacatgccgctggagctggccctgctgccggtgatcgagagcgcctacaacccgatggcctattcccgggccgacgcggtgggcctctggcagttcatcccgtccaccggccgctccttcaacctgcgccagacccgtttctacgatggccgtcgcgatatcaccgcctcgaccaccgcggccatggattacctgacccgcctgcacgacatgttcaacggcgactggctgctggccctggcggcctacaacgccggcgaaggcacggtcagccgggccatcgagcgcaacgagaagctcggcctgcccaccgactactggaacctgccgctgccggccgaaacccaagcctatgtgcccaagttgctggccctgtcccaggtggtgctggcgcccgaagcctacggcgtgaacctcaacccgatcgccaacgaaccttatttccaggtcgtcgaaatcaaccagcgcatggacctgtccaaggtcgccgcggtggccaatatcgacgaagacgagctgttccagctcaacccggccttcaagcagcgcaccaccatcgacggtccccagcatctgctggtgccgacgtccaaggcgcaactgctgagcgccagcctgtcgaccatgaaacccgaagaactcatcagccagcgttcgttcaagccggtgttcgagggggccgacagccgcgaaatggcccaggccaagcgcagctaccgggtcaagcgcggcgacaacctgtcgcagatcgccaaggccaacaaggtcgacgtcaaggacctgcaacgctggaacaagctcagcggcaagaacctcaaggtcggccagaccctggtcatgcaggacacccgcaaagccagcaccaagaccaacgccaaggcgtccggcaagaaaaccatggtcgccagcgccgacaagaagtcgacccagtacaaggtcaagcaaggcgattcgctgtacatggtggccaagcgcttcaacgtcgagatgcagcacctcaagcgctggaacccccgcgccggccaggctctcaagcccggccagatgctgaccgtctacctgcctcattga

SEQ ID NO: 2178 - DNA, 1440 bp, Pseudomonas sp.
atgtcgtcatctatacgcaggtccgtccagtcagacacattgacccgcttggctcaagccatcgcggtggctgtgtccgccactttggcgggctgccagagcacgagccaggtgtcgcagaccgacgcggcacacaccccgaatatcgccgctcgcgccaaacagaagcctgtctggctgagtgaaaagcccagcccgcaagtgccccaggatgtctgggagcgtatgcgccagggcttccagttgcaggaaacggcgggcgtcaacccgcgtatcgaacaacagcgtctgtggttcgccagcaacccttctttcctggaaaacgctggtgaacgcggcagcctgtatatccactacatcgtcgagcgcctcgaagaacgcaacatgccgctggaactggcgctgctgccagtaatcgagagcgcctacaaccccatggcctattcccgggccaacgcggtggggttgtggcagttcattccatccacggggcgctacttcaacctgcgccagacgcgtttctacgacggtcggcgcgacatcaccgcatccaccacggcggccatggactacctgacacgcctgcacgacatgttcaacggcgactggttgctggccctggcggcctacaacgccggtgaaggcacggtcagccgcgccatcgaacgcaacgaaaagcttggcctgcccaccgattactggaacctgccactgcccagcgagacccaggcctatgtgccgaagctgctggcgttgtcccaggtcgtgctttcccccgatgcctacggcgtgaacctcaacccgatcgccaacgaaccctacttccaggttgtcgagatcaaccagcgcatggacctgtccaaggtcgcggcggtggcgaacatcgacgaagacgagttgttccagctcaacccggcgttcaagcagcgcaccaccatcgacggcccccagcacttgctggtgcctacgtccaaggcccaactgctcaccgccagcctgtcgacgatgcgtccggaagaattgatcagcccgcgctcgctccagccggtcttcgaaaccgccgatgacagcgaagtggaaggcgcccggcgcacctaccgcgtcaagcgcggcgaaaacctggcacagatcgccaaggccaacaatgtccagaccaaggacctgcaacgctggaacaaactcagcggcaacaagctcaaggtcggccagaccctggtcatgcaggacgccaaggccaccggcaagcgcatcagcaccgtggtagccgccaacagcaaggaccagaagaagcagacccagtacaaggtcaaacagggtgactcgctgtacgttgtagccaagcgcttcaacgtcgagatgcagcacctcaagcgctggaacccgcgcatgggcaacgcgctcaagcctgggcagatgctgacggtctactcgcctcactga

SEQ ID NO: 2179 - DNA, 1449 bp, Pseudomonas sp.
atgtcgtcatctatacgcaggtccgtccagtcagacacattgacccgcttggctcaagccattgcggtggccgtgtccgccacattggcgggctgccagagcacgagccagctgccgcagaccgacgcggcgcacacgccgaatatcgccgctcgcgccaaacagaagccggtatggctcagtgagaaacccagccctcaagtaccccaggacgtctgggagcgcatgcgccagggtttccagctgcaggaaacggccggcgtcaatccacgtatcgagcaacagcgcctgtggttcgccagcaacccttccttcatggaaaacgccggtgagcgtggcagcctgtacatccattacatcgtcgaacgcctcgaagagcgcaacatgccgctggagctggcgttgctgccggtgatcgagagtgcctacaaccccatggcctattcccgggccaacgcagtgggcctgtggcaattcatcccgtccacggggcgttacttcaacctgcgccagacccgcttctatgacgggcgtcgcgatatcaccgcctccaccacggccgccctggactacctgacgcgcctgcacgacatgttcaacggcgactggttgctggcgctggccgcctacaacgccggcgagggtacggtcagccgcgccatcgagcgcaacgagaagcttggcctgcccaccgactactggaacctgccgctgcccagcgaaacccaggcttatgtgccgaagttgctggcgctgtcccaggtggtgctctcgcccgatgcctatggcgtgaacctcaacccgatcgccaacgaaccctatttccaggtcgtcgagatcaaccagcgcatggacctgtccaaggtcgcggcggtggccaacatcgacgaagacgagctgttccagctcaacccggccttcaagcagcgcaccaccatcgacggcccccagcacctgctggtgcccacgtccaaggcccagttgctgaccgccagcctgtcgaccatgcgccccgaagagctgataagccagcgctcgctcaagccggtgttcgagacagccgacgacagcgacgtggaaggcgcccggcgtacctaccgagtcaagcgcggcgaaagcctcgcccagatcgccaaggccaacaacgtccagaccaaagacctgcaacgctggaacaaactcagcggcaacaagctcaaggtcggccagaccctggtgatgcaggacgccaaggccagcaaggccaccagcaagcgcatcagcaccgtggtggccgccaatagcaaggaccagaagaagcagacccaatacaaggtcaagcaaggtgattcgctgtacgtcgtcgccaagcgtttcaacgtggaaatgcagcacctcaagcgctggaacccacggatgggcaaggccctcaagcctgggcagatgctgacggtctactccccgcactga

SEQ ID NO: 2180 - DNA, 1452 bp, Pseudomonas sp.
atgtcgtcatccatacgcaggtccgtcccgtcagctactttgacccgcctggctcaagccatcgcggtggctgtgtccgcgatcctggcgggctgccagagctcgggccagatcccccagaacgacgcggtcacgccgaagaacatggcggcccgtgccaagcagaagccggtctggctcagcgagaaacccagcccccaggccccccaggacatctgggagcgcatgcgccagggcttccagttgcaggaaaccgccggggtcaacccgcgtatcgagcaacagcgcctgtggttcgccagcaacccggcgttcctcgagggtgccggtgagcgcggcagcctgtacatgcactacatcgtcgaacgcctcgaagaacgcaacatgccactggagctggcgctcctgccggtgatcgaaagcgcctacaaccccatggcctattcacgggccaacgccgttggactatggcagttcattccgtccacgggtcgttacttcaacctgcgccagacccgcttctatgacgggcgtcgcgacatcaccgcctccaccacggcggccctggactacctgacgcgcctgcacgacatgttcaacggtgactggctgttggcgctggccgcctataacgccggcgaaggtacggtcagccgcgccatcgagcgtaacgaaaaactcggcctgcccaccgactactggaacctgccgctgcccgccgagacccaggcctacgtgcccaagctgctggcgctgtcccaggtggtgctcgcccccgaagcctatggggtgaacctcaacccgatcgccaatgagccctacttccaggtcgtcgagatcaaccagcgcatggacctgtccaaggtcgcggaggtggccaacatcgacgaagacgagctgttccagctcaacccggccttcaagcagcgcaccaccatcgacggcccgcagcacctgctggtgcccacctccaaggcccagttgctgaccgccagcctgtcgaccatgcgcccggaagagctgatcagccagcgctcgctcaaaccggttttcgaatccgccgatgacgctgaagtggaaggcgccaggcgcacctaccgcgtcaagcgcggtgacaacctgggccagatcgccaaggccaaccacgtccagacgaaggacctgcaacgctggaacaaactcagcggcagcaagctcaagatcggccagaccctggtgatgcaggacgccaggccggccaaggcgaccggcaagcgcatcaataccgtggtggccgccaacagcaccaaggaaaagaccaagcagacccaatacaaggtcaagcagggtgattcgttgtatgtcgtggccaagcgcttcaatgtggaaatgcaacacctcaagcgctggaacccacgcatgggcaaggccctcaagcctggacagatgctgacggtctattccccacactga

SEQ ID NO: 2181 - DNA, 1410 bp, Pseudomonas sp.
ttggctcaagccatcgcggtggctgtgtccgccaccctggcgggctgccaaagcacgagccacgtcccgcaaaccgacgcttcgcacacccagaatttcaacgcccgcatcaagcagaaacccatctggctgaatgaaaagcccagcccgcaattgccccaggacgtctgggagcgcatgcgcgaaggtttccagttgcaggaaggcatcggcgtcaacccgcgcatcgagcagcagcgcctgtggttcgccagcaatccatcgtttctcgagaatgccagcgaacgcggcagcctctatatccattacatcgtcgagcgccttgaagaacgcaacatgccgctggagctggccctgctgccagtgatcgagagcgcctacaacccgatggcctattcccgggccgacgcggtgggcctgtggcagttcatcccgtccaccggtcgttccttcaacctgcgccagacccgcttctacgatggccgtcgcgatatcaccgcctcgaccaccgcggccatggattacctgacccgcctgcacgacatgttcaacggcgactggctgctggccctggcggcctacaacgccggcgaaggcacggtcagccgggccatcgagcgcaacgagaagctcggcctgcccaccgactactggaacctgccgctgccgtcggaaacccaggcctacgtgcccaagctgctggccctgtcccaggtggtcatggcgcccgaggcctatggcgtcaacctgaacccgatcgccaacgaaccctacttccaggtcgtcgagatcaaccagcgcatggacctgtccaaggtcgccgcggtggccaacatcgacgaggacgagctgttccagctcaacccggccttcaagcagcgcaccaccatcgacggcccccagcacctgctggtgccgacgtccaaggcgcaactgctgagcgccagcctgtcgaccatgaaacccgaagagctgatcagccagcgttcgctcaagccggtgttcgagggcgccgacagtcgcgaaatggcccaggccaagcgcaactaccgggtcaagcgcggcgacaacctgtcgcagatcgccaaggccaacaaggtcgacgtcaaggacctgcaacgctggaacaagctcagcggcaagcagctcaaggtcggccagaccctggtcatgcaggacaccagcaaagccaagggcagcagcaagaccagcgccaaggcctccggcaagaagaccctggtcgccagcgccgacaagaagtcgacccagtacaaggtcaagcaaggcgattcgctgtacatggtggccaagcgcttcaacgtcgagatgcaacacctcaagcgctggaatccccgcgccggccaggccctcaagccaggccagatgctgaccgtctacctgcctcactga

SEQ ID NO: 2182 - DNA, 1401 bp, Pseudomonas sp.
ttggctcaagccattgcggtggccgtgtccgccacattggcgggctgccagagcacgagccagctgccgcagaccgacgcggcgcacacgccgaatatcgccgctcgcgccaaacagaagccggtatggctcagtgagaaacccagccctcaagtaccccaggacgtctgggagcgcatgcgccagggcttccagctgcaggaaacggtcggcgtcaatccacgtatcgagcaacagcgcctgtggttcgccagcaacccttccttcatggaaaacgccggtgagcgtggcagcctgtacatccattacatcgtcgaacgcctcgaagagcgcaacatgccgctggagctggcgttgctgccggtgatcgagagtgcctacaaccccatggcctattcccgggccaacgcagtgggcctgtggcaattcatcccgtccacggggcgttacttcaacctgcgccagacccgcttctatgacgggcgtcgcgatatcaccgcctccaccacggccgccctggactacctgacgcgcctgcacgacatgttcaacggcgactggttgctggcgctggccgcctacaacgccggcgagggtacggtcagccgcgccatcgagcgcaacgagaagcttggcctgcccaccgactactggaacctgccgctgcccagcgaaacccaggcttatgtgccgaagttgctggcgctgtcccaggtggtgctctcgcccgatgcctatggcgtgaacctcaacccgatcgccaacgaaccctatttccaggtcgtcgagatcaaccagcgcatggacctgtccaaggtcgcggcggtggccaacatcgacgaagacgagctgttccagctcaacccggccttcaagcagcgcaccaccatcgacggcccccagcacctgctggtgcccacgtccaaggcccagttgctgaccgccagcctgtcgaccatgcgccccgaagagctgatcagccagcgctcgctcaagccggtgttcgagacagccgacgacagcgacgtggaaggcgcccggcgtacctaccgagtcaagcgcggcgaaaacctcgcccagatcgccaaggccaacaacgtccagaccaaagacctgcaacgctggaacaaactcagcggcaacaagctcaaggtcggccagaccctggtgatgcaggacgccaaggccagcaaggccaccagcaagcgcatcagcaccgtggtggccgccaatagcaaggaccagaagaagcagacccaatacaaggtcaagcaaggtgattcgctgtacgtcgtcgccaagcgtttcaacgtggaaatgcagcacctcaagcgctggaacccacggatgggcaaggccctcaagcctgggcagatgctgacggtctactccccgcactga

SEQ ID NO: 2183 - DNA, 1413 bp, Pseudomonas sp.
atgtcgtcatctattcgtaaatccaaccattcagacgcattgacccgcctggctcaagccattgcggtggctgtatccgcaactctggcgggctgccaaaccaccaattacgctgcacaatccaccgtgcaacccaaacctgtcttaactgccaagatcaagcaaaaacccctttggctctcagagaagccaagcccacaggtgccccaggatgtctgggagcgcatgcgccaggggttccaattgcaggacggcgtcggcgtcaacccgcgtatcgagcaacaacgcctgtggttcgccagcaacccctctttcctggagaacgccggcgaacgcggcagtctctatattcattacatcgtcgagcgccttgaagagcgcaacatgcccctggagctggcgctgctgccagtcattgaaagtgcctacaacccaatggcctattcacgcagcgatgcggttggcctgtggcagttcattccctccaccgggcgctacttcaacctgcgccagacccgcgcctacgatggccgtcgcgatatcaccgcctccaccactgctgccctggactatctgacacgtctgcatgatatgttcaacggcgactggttgctggccctggcggcctataacgcgggtgaaggcacggtcagccgggccatcgaacgtaacgaaaagctcggtctgcccaccgactactggaacctgccactgccccaggaaaccaaggactacgtgcccaagttcctggcgctgtcccaagtggtgctggctcccgaggcctacggcgtcaacctgaacccgattgccaacgcgccgtacttcgagatggttgaagtcaagcaaagcatggacctgtcccgggtcgctgcgctggctgagatcgacgaagacgaactgttccagctcaacccggccttcaagcaacgcactaccctggacggcccccagcatttgctggtgcccacctccaaggcgcaattgctggccagtagcctgtcctcgatgaatcccgaggagttgttgagcctgcgcccgaaaaagccggtgttcgacgaggttgagcacaaggccgtggccggccgctcgcgcagctacaaggtcaagagcggtgacaacctgacgctgattgccaaggccaacaaggtcgacgtgcatgacctgcagcgctggaacaagctcaatggccaggccttgaaagtcggccagaccctggtgatgcaggacacccgcaaagtcgtggccaaggctggcggcaagaagccggtgcagtacaaggtcaagaaaggtgactcgctgtacatggttgccaagcgcttcaacgtcgagatgcaacatctcaagcgttggaacccacgcactggccaggcgctgaagccggggcagatgctggtggtgtccgggccgcgctga

SEQ ID NO: 2184 - DNA, 1410 bp, Pseudomonas sp.
atgtcgtcatctattcgtaaatccaaccattcagacgcattgacccgcctggctcaagctgtggcggtggctgtgtccgcaacactggcgggctgccaatcgaccaatttcactgcacaatccaccgtgcaacccaagcccaaccttaccgccaaaatcaaacagaaacccgtcatctggctttcagaaaagcctgctcccgaagtaccgcaggatgtctgggaacgcatgcgacggggctttcaattgcaggacaacgttggcgtcaacccgcgcatcgagcaacagcgcctgtggttcgccagcaacccgtccttcctggagaacgccggcgaacgcggcagtctctacattcattacatcgtcgaacgccttgaagaacgcaacatgcccctggagctggcgctgctgccagtgatcgaaagtgcctacaacccaatggcctattcgcgcagcgatgccgtcggcttgtggcagttcatcccctccaccgggcgctacttcaacctgcgccagacccgcgcctatgatggccgccgcgacattaccgcctccaccaccgccgccctagactacctgacccgtctgcacgacatgttcaacggcgactggctgctggcgctggcagcctataacgccggcgaaggcacggtgagccgggcgatcgagcgcaacgagaagctcggtctgcccaccgactactggaacctgcccctgccccaggaaaccaaggattacgtgcccaagttcctggcgctgtcccaggtggtgctggcccctgaggcctacggcgtcaacctgaacccgattgccaacacgccttacttcgaagtcgtagaagtcaaacaaagcatggacctgtcccgggtcgccgcgctggcggagatcgacgaagacgagctgttccagctcaacccggccctcaaacaacgcaccaccctggatggcccgcagcatctgttggtaccgagttccaaggcgcagttgctgaccagcaccctttcgacgatgaagcctgaagaattactggcgatgcgcccgaagaaacaggtcttcgacgaagttgagaccgcacgggttgccggccgcagccgaagctacaaggtgcgcagcggcgacaacctcacgctgattgccaaggccaacaaggtcgatgtgcatgacctgcaacgctggaacaagcttaacggccaggccctcaaggttggtcagaccctggtgatgcaggacacccgccgcgcagtagccagcagcaagaagccggtgcagtacaaggtcaagaaaggcgactcgctgtacatcgtcgccaagcgtttcaacgtcgagatgcaacatctcaagcgttggaacccgcgtactggccaggcattgaagccggggcagatgctggtagtttccgggccgcgctaa

SEQ ID NO: 2185 - DNA, 1404 bp, Pseudomonas sp.
atgtcgtcacttaaccgaaaatccatcaataaagacgcgttgacgcgattggctcaagctatcgcggtggctgtgtccgccaccctggcgggctgccaaagctttcatcatccggcagataacagcaccgaaccggccccgaacctcagcgccaggatcaagcaaaaacccatctggctcggcgaaaaagccaacccaacgccacctcaggatgtctgggagcgcatgcgccagggcttcaagctgcaagatggcctgggggtgaacccgcgtatcgaacagcagcgcttgtggttcgccagcaacccttcgttcctggaaaatgccggcgagcgcggcaccctctacattcactacatcgtcgagcgcctcgaagagcgcaatatgccgctggaactggcgctgttgccggtcatcgaaagtgcctacaacccgatggcctattcacgtgccgatgcagtgggcctgtggcaattcatcccatccaccgggcgctatttcaacctgcgccaggatcgcttctacgacggtcgtcgcgacatcaccgcctcgaccctcgcggcgatgaactatctgacccgcctgcacgatatgttcaacggcgactggctgctggccctggcggcctacaatgccggtgaaggcactgtcagccgggcgatcgagcgtaacgaaaagctcggcctgcccaccgactactggaacctgccgctgccccaggaaacccgtgactacgtgcccaagctgctggccctgtcccaggtggtcatggcgcccgaagcctacggcgtgaacctcaatccaattgccaacgagccttatttcgctaccgtcgaagtcaatcaaccgatggacctttctcgcgtcgcggccctggccgagatcgacgaagacgagatgatccaattgaatccggcctacaaacagaaggcgacccttgatggtccgcaacacctgttggtgccgagctccaaggcacaattgctgaccgccagcctgtcgaacctcaaacccgaggaactggtcagcttgcggccaaaaaagccggtattcgaaaacgtcgccagcaatgacccggtacgcctgaaccgccgctacaaggtcaagaacggcgacaacctgacctcgatcgccaaggccaacaaagttgatgtcaaggacttgcagcactggaacaagttatccggccagaagctgaagatcggccagaccctggtcatgcaggacaatgtccgggctgaggccagccaacaggccacgacttacaaagtccagaaaggcgactcgttgtacatcgtcgccaagcgcttcaaccttgagatgcaacacctcaagcgcctcaacccgcgcaccggccaggccttgaaaccaggccagatcctgacggtttcccagtcgcgctga

SEQ ID NO: 2186 - DNA, 1401 bp, Pseudomonas sp.
atgtcgtcatttaaaggttactccatcaattcagacgcattgacgcgcttggttaaagccatcgcggtggctgtgtccgccactcttgcgggctgccaatccatggatcattcggcgcaaaccaccgaacgggccagcctgaaaatcgccaagcgcatccctcaagagccgctctggctcagcgaaaaacctagccccgttgccccgcaagatgtctgggagcggatgcgccaagggttcaaattgcaggacggccagaacgttaacccccgcattgaacaacagcgcttgtggtttgccagcaatccgtcattcctcgagaacgcaggggagcgtggcagtctttacatccactacatcgtcgaacgcctcgaagagcgcaacatgccgctggagttggccctgttgccagccatcgaaagcgcctacaacccaatggcgtactcccacgccaatgcggtcggtctctggcaatttatcccttcgacgggccgctatttcaatttgcgtcaaacccgtgcttacgacggtcgccgtgacattaccgcctcgaccctggcagccctgaactacctgaaccgtctgcacgacatgttcaacggtgactggctgctggccctggcggcttacaacgcaggcgaaggtactgttagccgggccatcgagcgcaatgaaaaactcggcttgccgaccgattactggaacctgccactgccgcaggaaaccaaagactacgttccaaaactgctggcactgtcccaagtggttctggcccctgaagcctatggcatcaacctgaatccgatcgccaacgaaccctacttcgaaatggtcgaaatcaagcagtccatggatctgtcccgcgtggcagccctggccgagatcgacgaagacgagatgtttcagctgaatccggcttacaagcagcgcgccacgaccgatggcccgcaacacctgcttgtgcccacctccaaagcgcagttgctgaccgccagcctttccaacctcaagcccgaagaactcgtcagtctgcgccctaaaaagcctgtgtttgacagcattgcgagcaatcaaccggcacggcttaaccgcaagtaccgggttaaaagtggcgacaacctgaccctgattgccaaagccaacaaggttgatgtcaaagacctgcagcattggaacaaactaagcggcaacaacctcaaggccggtcagatcctggtcatgcaggacacccgcaagtccacgggcagaaagcctacccaatacaaggtcaaaaaaggcgactcgctgtacatcgttgccaagcgtttcaacgttgaaatgcaacatctcaagcgctggaacccaagcagcgcaaaagccctgaaacccgggcagatgctgacagtttcaaaaccgcgttaa

SEQ ID NO: 2187 - DNA, 1404 bp, Pseudomonas sp.
atgtcgtcatctatacgtaacttcatcaaaacagacacattgacgcgtcttgcgcaagccatcgcgctggccgtgtccgctgtactcgcgggttgtcaaagcatggatcaatcagccaaaacggccgaaagacccacgttgaaactgaccaaacgcattcctcaggagccgatctggctcagcgaaaaacccagccctgtagccccacaagatgtgtgggagcggatgcgtcagggtttcaagttgcaggaaggcgtagaagttaacccgcgaatcgaacaacagcgcctgtggttcgccagcaacccttcgtttctcgaaaacgcaggtgagcgtggcagcctttatattcactacatcgtagagcgcctcgaagaacgcaacatgccgctggaactggctctgctgcccgtcattgaaagcgcttacaacccgatggcgtattcccacgccaatgccgtcggtctgtggcagttcattccatcgaccggccgctacttcaacctgcgccaaacccgtgcctatgacgggcgtaaagacatcaccgcctcaaccctggcggccatgaattatctgacccgtctgcatgacatgttcaatggcgactggttgctggcgctggcggcttacaacgcaggcgaaggcaccgtaagccgggccatcgaacgcaacgaaaagctcggtttgccgacggattactggaacctgcccctgccgcaggaaaccaaagactacgttccgaaattgttggctctgtcccaagtggtaatggcccctgaagcttatggcatcaatctgaacccgattgccaacgaaccgtacttcgaaatggttgaaatcaaacaatccatggacttgtcccgcgttgctgcgctggccgagatcgacgaagacgaaatgtttcagctcaatccggcttacaagcaacgagccaccacggatggcccgcagcatctgctggtgccgacctccaaagctcagttactgaccaccagcctgtccaacctcagacctgatgaactgatcagcctgcgccccaaaaaagcggtattcgacaatgtggccagcaacacggccgtgcgccttaaccgtaagtacaaggtcaaaagtggcgacaacctgaccaccattgccaaggccaacaaggtcaatgtccgtgacttgcagcgctggaacaaactgaccggcaaaaacctcaagagcggccagatgctggtgatgcaggacacgcgcaaacccgcagccagcaagaaagccacccaatacaaagtgaaaaagggtgactcgctgtacatcgtcgccaaacgctttaacgtcgagatgcaacacctcaagcgctggaaccctaacagcgccaaggcactcaagcctgggcaaatgttgacggtttcaaacccacgctaa

SEQ ID NO: 2188 - DNA, 1404 bp, Pseudomonas sp.
atgctgtcacctaaccgaaaaaccatcaattcaggcacattgacgcgattggctcaggcagtcgccgtggctgtgtccgccactctggcgggctgccaaggcttgcaccacccctcggacaacggcaccgaaacggcgtcgaacctcaacgtccggatcaagcaaaagccgatctgggtcggcgaaaaaaccaacccgacgccgccacaggatgtctgggagcgcatgcgccagggcttcaagctgcaggatggcctgggcgtcaacccacgcatcgagcagcaacgcctgtggttcgccagtaacccgtcgttcctcgaaaacgccagcgagcgcggcacactttatatccattacatcgtcgaacgtctcgaagaacgcaacatgccgctggaactggcgctgttgccggtcatcgagagtgcctacaacccgatggcctactcgcgtgcagatgcggtcggtctctggcagttcattccctccaccgggcgcaacttcaacctgcgccaggaccgtttctacgatggacgccgcgatatcaccgcctcgaccatcgcggcgctgaactacctgacccgcctgcacgacatgttcaatggcgactggctgctggccatggccgcctacaacgccggcgaaggtacggtcagccgggcgatcgagcgtaacgagaagctcggcctgcccaccgactactggaacctgccgctgccccaggaaacccgtgactacgtgcccaagctgctggccttgtcgcaggtggtgatgtccccggaagcctatggcgtgaacctcaacccgatcgccaacgaaccctacttcgccagtatcgaagtcaaccagccgatggacctttcgcgggtcgcggccctggccgagatcgacgaagatgaaatgatccagttgaacccggcctacaagcagaaagcgaccctcgacggtccgcagcacctgctggtaccgagttccaaggcacagttgctgaccgccagcctgtcgaacctcaagcctgaagaactggtgagcctacggccgaaaaagccggtcttcgaaagcgttgccagcaacggtccggtccgccgttacaaggtcaggaacggcgacagcctgtcgtcgatcgccaaggccaacaaggtcgatatcaaagaactgcaacgcttgaacaagctgtccgggcataagttgaaggtcggtcagaccctggtcatgcaggggaatgtccgtgcgccgatcagcaagaagtcggctgcccccacgacctacaaggtgcagaaaggcgactccctttatattgtcgccaaacgtttcaatgtcgaaatgcagcatctcaagcgcctcaatccgcgcaccggccaggcactcaagccaggtcagatcctcacagtttcccagccacactga

SEQ ID NO: 2189 - DNA, 1224 bp, Pseudomonas sp.
atgcgccagggtttccaactgcaggaaacagccggcgtcaacccacgcatcgagcaacagcgcctgtggttcgccagcaatccctctttcctggaaaacgccggtgagcgcggcagcctgtacatccattacatcgtcgaacgcctcgaagagcgcaacatgccgctggagctggcgctgctgcctgtgatcgagagtgcctacaacccgatggcctattcccgggccaacgccgtgggcctgtggcaattcatcccgtccacggggcgttacttcaacctgcgccagacccgcttctatgacgggcgtcgcgatatcaccgcctccaccacggccgccatggactacctgacgcgcctgcacgacatgttcaacggcgactggttgctggcactggcggcctacaacgccggcgaaggcacggtcagccgcgccatcgagcgcaacgagaagcttggcctgcccaccgactactggaacctgccgctgcccagcgagacccaggcctatgtgccgaagttgctggcactgtcccaggtggtgctctcgcccgatgcctatggcgtgaacctcaacccgatcgccaacgaaccctatttccaggtcgtcgagatcaaccagcgcatggacctgtccaaggtcgcggcggtggccaacatcgatgaagacgagctgttccagctcaacccggccttcaagcagcgcaccaccatcgacggcccccagcacctgctggtgccaacgtccaaggcccagttgctgaccgccagcctgtcgaccatgcgcccggaagagctgatcagccagcgctcgctcaagccggtcttcgaatcggccgacgacagcgacgtggcaggcgcaaagcgcacctaccgcgtcaagcgcggcgacaacctcgcccagatcgccaaggccaacaacgtccagaccaaggacctgcaacgctggaacaaactcagtggcaacaagctcaaggtcggccagaccctggtgatgcaggatgccaaggccagcaaggccgccggcaagcgcatcagcaccgtggtggccgccaatagcaaggaccagaagaagcagacccaatacaaggtcaagcaaggtgattcgttgtacgtcgtcgccaagcgcttcaacgtggaaatgcagcacctcaagcgctggaacccgcggatgggcaaggctctcaagcctgggcagatgctgacggtctactccccccactaa

SEQ ID NO: 2190 - DNA, 1404 bp, unknown
  environmental sample
atgtcgtcatctatacgtaaaccttctcaattcgacacattgacgcgcctggcgcaggcaattgccttggcactgtccgccacattggtggggtgccagagcacgagccacacgccagacatggagccggttcgcgcccacaacctgaacaaccgcatcaaacaaaagccgcttttcgtcaatcagcagcctgctcagcaggcgccgcaagacgtctgggagcgcatgcgccagggcttccagttgcaggatagcgtggccgtcaaccctcgagtcgagcaacaaaggttatggttcgtcagcaacccgacctttctcgaaaccgccagcgaccgcggcagcctctatatgcactacgtggtcgagcgcctcgaagaacgcgatatgcccctggaactggcattgttgccggtcatcgaaagcgcctacaacccaatggcttattcgcgggccaacgccgccggcctttggcagtttatcccttctacagggcgctacttcaaccttagccagactcgcttctatgacggccgccgcgatgtcaccgcctccaccgccgccgcactggactacctgacccgcctgcatgacatgttcaacggcgactggctgttggccctggcggcctacaatgccggcgaagggaccgtcagccgggccatggagcgcaacgaaaaactcggcctgccgaccgactattggaacctgccgctgccccaggaaacccgcgactacgtacccaagctgctggcgttgtcggaattggtcatgtcgccgcaagcctacggcgtgaacctcagcccgatcgccaacgaaccctacttcgaagtggtcgaagtcaatcagcgcatggacctttcccgcgttgcggccctggccgatatcgacgaagacgaaatgttccagctcaacccggcgttcaagcagcgggtcaccgtgcagcccaaacagcacttgctgatccccaccgccaaggcccaattgctgaccgccagcctgtcgaacatgcggcctgatgaattgctcagcctgcagccgcagaaaaaagtcttcgaagacgtcgccgtggtcgagcccgcgcgcaagcgcgtgtacaaggtacgcgccggcgacaacctgggcctcattgccaaggccaacaaggtcgatatcaaagacctgcagcgctggaaccgaacctcgggcaagaacctcaaggttggccaaaccttggtcatgcaagacacgtcggccccgcaatcgagcaagcagaagaccaccacgtataaggtccgcaagggcgactcgctgtatctggtcgccaagcgtttcaacgtcgagatgcaacacctcaagcgttggaacccacgtaccggccacgccttgaagcctggccagaccctcacggtgtacctggatcgctga

SEQ ID NO: 2191 - DNA, 1569 bp, Pseudomonas sp.
atgtcgtcatctattcgttattccatcagttcagacgcattgacgcgcttggcccaggccatcgcggtagctgtgtcagcgacgcttgcgggctgccaaagcaccggccatgccccgcagagcgacgcgacacacacccagaatttcaacgcccgcatcaagcaaaaacccatctggctgagcaacaagccaagcccgcaagtaccccaggacgtctgggaacgcatgcgccaggggttccaattgcaggaaggcctgggcgtcaacccgcgtattgaacagcagcgcctgtggttcgccagcaacccttctttcctggaaaacgccggcgaacgcggcagcctctatatccactacatcgtcgagcgtctcgaagagcgcaacatgccgctggagctggccctgctgccggtgatcgaaagcgcctacaacccgctggcctattcccgggccgatgccgtgggcctgtggcagttcgtcccggccaccgggcgctacttcaacctgcgccagacccgcttctacgatggccgccgcgacatcaccgcctccaccaccgccgccctggactacctgacccgcctgcacgacatgttcaacggtgactggttgctggccctggctgcctacaacgccggcgaaggcaccgtgagccgggccatcgagcgcaatgacaagctcggcctgcccaccgactactggaacctgccgctgccggccgagactcaagcctacgtgcccaagctgctggccctgtcccaggtggtactggccccgcaggcctacggcgtgaacctcaacccgatcgccaacgaaccctacttccaggtggtggaaatcaaccagcgcatggacctgtccaaggtcgcggcggtggccaacatcgacgaggacgagctgttccagctcaacccggcgttcaagcagcgcaccaccgtcgacggtccacagcacctgctggtgcccacgtccaaggcccagttgctgaccaccagcctgtccaccatgaaacccgaagagctgatcagcaagcgctccctcaagccggtcttcgaccgcgacgaaggccgcgactcgctgcgacccaagcgcatctaccgggtcaagaacggagacaacctgaccctgatcgccaaggccaacaaggtggatgtgcaggacctgcagcgctggaacaagctcagcggcaagaacctcaaggtcggccagaccctggtcatgcaggacacccgcaaggccgccggcaagaaaccagcgtggccagcagcggcaagcagaagtcgacccgctacaaggtcaagcaaggcgactcgctgtacatcgtggccaagcgtttcaatgtcgagatgcagcacctcaagcgctggaacccgcgggcggcgcaagccctcaagccgggccagatgctcacggtctacctgccacactgaaacccgctctgtaggagccggcttgccggcgaacagccttcgccgacaagccggctcctacaggagatttcaattgcacaaagctcgcgccagcgagctttttcctgctgatacaagctgttactgtacggagcattaa

SEQ ID NO: 2192 - DNA, 1416 bp, Pseudomonas sp.
atgtcttcccgtagccgcagaacccctcattcagtcgccctgaggcgcctggcccagatcagtgcgctggcgctggccgccaccctggtgggctgccagagcacccgtcagctcgacgaagccgagagcgttcgcgcgcacaactaccaggcgcggatcaagcacaagcctgccccgctcgcggtcaaacccgtcgagccgccgcaggatgtgtgggagcgcatgcgccagggcttcgccctgcaggacagcatcgacgtcaatccgcgtatcgagcagcagcgcctgtggttcgccagcaacccttcgttcctcgagaacgccggcgagcgcggcagcctctacctgcactacatcgtcgaacgcctcgaagaacgcgacatgccgctggagctggcgctgctgccggcgatcgagagcgcctacaacccaatggcctactcgcgcgcccatgccgcgggcatgtggcagttcatcccgtccaccgggcgtcacttcaacctgcgccagaccaacttctatgacggccgccgcgacgtcaccgcgtcgaccaacgccgcgctggactacctgacccgcctgcatgacatgttcaacggcgactggctgctggccctggccgcctacaacgccggcgaaggcaccgtcagccgggcgatcgagcgcaacgaaaagctcggcctgcccaccgactactggaacctgccactgccgcaggaaacccgcgactacgtgcccaagctgctggccctgtcgcaggtggtctcgaccccagaggcctacggcgtgaacctcaacccgatcgccaacgagccctacttcgaagcagtcgccatcaacgaacgcctcgacctgtcgcgcgtggctgccttcgccaacatcgacgaggacgagctgatccagctcaacccggcattcaagaagcgcatgaccgtcgatgggccgcagcaactgctggtgccgaccgccaaggcgcagttgctgaccgacctcaagcccgagcagttgatcagcctcaagccgaacaaggctgtattcgagcgcgcagtcgccgaagcccgagcgccggcgactgcacgcacctaccgggtcaagcgtggcgacaacctgggcaccatcgccaaggccaaccgggtgtcggtcaaggacatccagcgctggaacaaactgccgggcaatcgtgttaaagccgggcaggttctggcactgcgcggcggcaatgcgccgagcgccgcgggaaaccgggtggcagcctccggcgagcgcacgacccaatacaaggtccgcaagggtgactcgctgtatttggttgccaaacgtttcaatgtcgagatgcagcacctcaagcgctggaacccgcgtagcggccatgcgctgaagccgggccagaccttgaccgtctacctgccgcattga

SEQ ID NO: 2193 - DNA, 1287 bp, Pseudomonas sp.
atgtcgtcatctattcgtaaatccatttcttcagacgcattgacccgcctggctcaagccgtggcggtggccgtttccgcaactctggcgggctgccaatcgaccaattacgctgcacaatccaccgtgcaacccaaaccgaatcttgctgccaagatcaagcaaaaacctatttggctatcagagaagcctagccccgaagtgccccaggatgtctgggaacgcatgcgtcggggctttcaattgcaggacggtgtcggcgtcaacccgcgcatcgagcaacagcgcctgtggttcgccagcaacccctcctttctggagaatgccggcgaacgcggcagcctctacattcattacatcgtcgaacgccttgaagaacgcaacatgcccctggagctcgcgctgctgccagtgattgagagtgcctacaacccaatggcctattcgcgcagcgatgcggtcggcttgtggcagttcattccctccaccgggcgctacttcaacctgcgccagacccgcgcctacgacggccgccgcgacatcaccgcctccaccacggccgccctggactatctgacgcgtctgcatgacatgttcaacggcgactggctgctggccctggcggcctataacgccggcgaaggcacagtgagccgggcaatcgagcgcaacgaaaagctcggcctgcccaccgattactggaacctgcccctgccccaggaaaccaaggactacgtgcccaagttcctggccttgtcccaggtggtactggcgcccgaagcctacggcgtcaacctgaacccgattgccaacacgccgtacttcgaggtcgttgaagtcaagcaaagcatggacctgtcacgggttgccgcgctggccgagatcgacgaagacgaactgttccagctcaacccggccttgaaacaacgcaccaccctggacggcccccagcatctgctggtgccgacctccaaggcccagttgctgaccagcaccctttcgacgatgaagccggaagaattgctgagcatgcgcccgaaaaagccggtgttcgacgaagtcgagaccaaggcggttgccgggcgtacccgcagctacaaggtacgcagtggcgacaacctcacgctgatcgccaaggccaacaaggtcgatgtgcatgacctgcagcgctggaacaagctcaacggccaggccctcaaggtcggccagaccctggtgatgcaggacacgcgtaaagtcgcggcgaaaaaaccggtgcagtacaaggtcaagaaaggtgactcgctg

SEQ ID NO: 2194 - DNA, 771 bp, Pseudomonas sp.
atgaaaccattgagcaaactctgcctgatcgccgccagcctgttgatgctcggcaccggatccgccatggccagcgacatcgcgccggtcaaggccaacaacgtcgtgctggtgcacggctcctgggccgatggctcgagctgggcggacgtgatctcgcggttgcaggctgccggactgcacgtcaccgccgtacaaaacccgctgacctcggtggccgacgacgtcgccgcgacccagcgcgtactcaatcagcaagacggcccgacggtgctggtcggccactcctacgccggcaccgtggtcagtgaagccggggtcaatcccaaggtcagttcgctggtatacgtcgccgcccgcgcgccggacgccggggaagatttcgtcgcgttatcaggtaaatacccgaccatgcccgtgcgcgccggcaccgaagaacacgacggtttcgtcagcctgaagcaggacgccttcctcaagtactttgccagcgacgtgccccacgacaaggcgatgcaactgttcgccgtgcagcaaccgatcgccaagaccctgttcaccgatcgcaccaccgcagccgcctggcacagcaaaccgtcgtggtacgcggtctccagcctcgaccagaccatcaatccggacctcgaacgattcctcgccaagcgcatgggcgcgaccaccatcgagctgccgtcgagccacttgtcgctggtctcccactccaaagagatcgccgacctgatcctcgaagcctcgggccgccagccttaa

SEQ ID NO: 2195 - DNA, 771 bp, Pseudomonas sp.
atgaaaccattgaacaaactctgcctgatcgccgccagcctgctgatgctcggcaccggctccgccatggccggcgacatcgcgccggtcaaggccgacaacgtcgtgctggtacacggctcctgggctgatggctcaagttgggcggacgtgatttcgcggttacaggccgccggattgcacgtcaccgccgttcaaaacccgttgacctcggtcgccgatgacgtcgccgccacccagcgtgtactcaaccaacaggacggcccgacggtgttggtcggccactcctacgccggcaccgtggtcagtgaggccggggtgaacccaaaggtcagctcgctggtatacgtcgcggcccgcgccccggacgccggggaagatttcgtcgccctgtcagccaaatacccgaccatgcccgtgcgtgccggcaccgaagaacacgacggtttcgtcagcctgaaacaggatgccttcctcaaatatttcgccagcgacgtgccccacgacaaggcgatgcaactgttcgccgtgcagcaaccgattgccaaaaccctgttcactgatcgcaccaccgcagccgcctggcacagcaaaccgtcgtggtacgcagtctccagcctcgaccagaccatcaacccggacctcgaacgcttcctcgccaaacgcatgggcgcgaccaccatcgagctgccgtcgagccatttgtcgctggtttcccattccaaagaaatcgccgacctgatcctcgaagcctccggtcgccagccataa

SEQ ID NO: 2196 - DNA, 771 bp, Pseudomonas sp.
atgaaaccattgagcaaactctgcctgatcgccgccagcctgttcatgctgggcagcggttccgccatggccgccagcaccgcaccggtcaaggccaacaacgtcgtgctggtgcacggctcctgggctgatggctccagttggtcggacgtaatcgcccgtttgcaggctgccggcttgcacgtcactgcggtgcagaacccgctgacctcagtggccgatgacgttgctgcaacccaacgggtcctcgatcaacaggacgggccgaccgtgctggtcggccattcctacgccggcacggtggtcagtgaggccggggtcaatccgaaggtcagttcgctggtgtacgtcgctgcccgcgcgccggatgccggggaagacttcgtcgccctgtcggccaaatacccgaccatgcccgtgcgcgccggcaccgaagagcacgatggttttatcagcctgaagcaagacgccttcctcaaatacttcgccagcgacgtgccccacgacaaggccatgcagctgttcgccgtgcaacagccgatcgccaagacgctgttcaccgaccgcaccaccgctgcggcctggcacaccaagccgtcgtggtacgcggtgtccagccaggatcagaccatcaacccggacctggaacgtttcctcgccaaacgcatgggcgcgaccaccatcgaactgccgtcgagccacttgtcgctggtgtcccattccaaggaaatcgccgacctgatcctcgctgccgccggtcgccagtcataa

SEQ ID NO: 2197 - DNA, 762 bp, Pseudomonas sp.
atgagcaaactctgcctgatcgccgccagcctgttgatactgggcaccggttccgccatggccagcgacatcgcgccggtcaaggccaacaacgtcgtgctggtgcacggttcctgggccgatggctcaagctggtcggacgtgatcacccggttgcaggctgccggcttgcacgtgactgcggtgcaaaaccccttgacctcagtcgccgacgacgttgccgcaacccagcgcgtgctcgatcgacaagacggcccaaccgtgctggtcggccactcctacgccggcaccgtggttagtgaagccggggtcaatccgaatgttagctcgctggtttatgtcgccgcccgagcaccggatgcgggcgaggacttcgtcgcgctgtcggccaagtacccgaccatgcccgtgcgcgccggcaccgaagaacacgatggtttcatcagcctgaagcaagacgccttcctcaagtacttcgccagtgacgtgccccatgaaaaggcaatggaactgtttgccgtccagcaaccgatcgccaaaaccctgttcaccgaccgcaccaccgctgccgcctggcacaccaaaccatcctggtacgcggtctccagcctcgatcaggccatcaacccagacctggaacgcttcctcgccaaacgcatgaacgcgaccaccatcgagctgccgtcgagccatctgtctttggtctcccacgccaaagaaatcgctgacctgatcctcgaagccgctggtcgccaaccgtaa

SEQ ID NO: 2198 - DNA, 774 bp, Pseudomonas sp.
atgaaaccattgagcaaactctgcctgatcgccgccaccctgttcgtgctgagcagcggttgcgccatggctgccaccacgaccgcaccggtcaaggccaacaacgtcgtgctggtgcacggttcctgggccgatggctccagttggtcggatgtgatcagccgcttgcaggccgccggcctgcacgtgacggcggtgcaaaacccgctgacgtcggtggccgacgacgtcgccgcgacccagcgcgtgctcgatcagcaagacggcccgaccgtgttggtcggccactcctacgccggcacggtggtcagcgaggccggggtcaatccgaaggtcagttcgctggtgtacgtcgccgcgcgtgcgccggatgccggggaagatttcgttgccctctcggccagatacccgaccatgcctgtacgtgccggtaccgaagaacacgacggtttcgtcagtctcaagcaagacgccttcctcaactacttcgccagcgacgtgccccgcgacaaagccatgcagctgttcgccgtgcaacaaccgattgccaagaccctgttcagcgaacgcaccaccgctgcggcctggcacaccaaaccgtcgtggtacgccgtatccagccaggaccagacgatcaacccggaccttgagcgcttcctggccaggcgcatgggtgccaccaccattgaattgccgtcgagccacttgtcgctggtgtcccactccagggaaatcgccgacctgatccttgctgccgccggtcgccagccgtaa

SEQ ID NO: 2199 - DNA, 771 bp, Pseudomonas sp.
atgaaacctgctagcaaactctgcctgatcgccgccagcctcctgatgctgggcactggcagcgccatggcgggcaccatcgcaccggtcaaagccaagaatgtggtgctggtgcacggctcctgggctgacggttcgagctggtccgaggtgattacccgcctccaggccgcggggctgcacgtcaccgccgtgcaaaacccgctgacctcggtggccgacgatgttgccgccacccaccgtgtgctggatcaacaagacggcccgaccgtgctggtcggccattcctatgcaggcaccgtggtcagcgacgccggggtcaacccgaaagtcagcgccctggtctacgtggccgccagggctccagacgccaacgaagacttcgtcgcgctctcagccaagtacccgaccatgcctgttcgcgctggcgtcgaagaccacgacggctacctcaccctgagccaggacgccttcctcaagtacttcgccgccgatgtgccacacgccaaggccatggagctgtacgccgtgcagcaacccatcaccaagaccctgttcagcggccgcactgtcaatgcggcctggcacaccaagccatcgtggtatgcggtgtcggcgaatgaccagaccatcaaccctgaccttgagcgcttcctcgccaagcgtatgaacgccaccaccatcgagctgccatcgagccacttgtcactggtgtcccacgccaaggaaatcaccgatctgatcctcgaagcctcgggccgccagccttaa

SEQ ID NO: 2200 - DNA, 771 bp, Pseudomonas sp.
atgaaacctgcaagcaaactctgcctgatcgccgccagcctgttgatgctggggaccggcgccgccgtggccggcccgattgcaccggtgaaagccaataacgtagtgctggtacacggctcctgggccgacggttccagttggtccgaagtgattacccgcctgcaggccgccggcttgcatgtaaccgccgtgcaaaacccgctgacctcggtggcggatgacgtcgctgccaccaatcgcgtactcgatcaacaggacggtcctaccgtgctggtcggccattcctacgccggcaccgtggtcagcgacgccggggccaaccccaaggtcagctccctggtatacgtcgccgcccgcgctccggacgccaacgaagacttcgtcgccctgtccgccaagtacccaagcacacccgtgcgggccggtgtggtggagcacgacggttacctgaccctgaatcaggacgccttcctcaagtactttgccgccgacgtaccccacgccaaggccatggagctgtacgccgtgcaacaaccgatcgccaagaccctgttcagcggtcgcaccgtcaacgccgcgtggcacaccaagccgtcctggtatgcggtgtccagcaatgaccagaccatcaacccggacctggaacgctttctcgccaagcgcatgaacgccaccaccatcgagctgccatcgagccacttgtccctggtttcccacgccaaggaaatcaccgacctgatcctcgaagcgtccggccgccagccttaa

SEQ ID NO: 2201 - DNA, 771 bp, Pseudomonas sp.
atgaaacctgcaagcaaactctgcctgatcgccgccagcctgttgatgctggggaccggcgccgccgtggccggcccgattgcaccggtgaaagccaataacgtagtgctggtacacggctcctgggccgacggttccagttggtccgaagtgattacccgcctgcaggccgccggcttgcatgtaaccgccgtgcaaaacccgctgacctcagtggcggatgacgttgccgccaccaatcgcgtactcgatcaacaggacggccctaccgtgctggtcggccattcctacgccggcaccgtggtcagcgacgccggggccaaccccaaggtcagctccctggtatacgtcgccgcccgcgctccggacgccaacgaagacttcgtcgccctgtccgccaagtacccaagcacacccgtgcgggccggtgtggtggagcacgacggttacctgaccctgaaccaggacgccttcctcaagtactttgccgccgatgtaccccacgccaaggccatggagctgtacgccgtgcaacaaccgatcgccaagaccctgttcagcggtcgcaccgtcaacgccgcgtggcacaccaagccgtcctggtatgcggtgtccagcaatgaccagaccatcaacccggacctggaacgctttctcgccaagcgcatgaacgccaccaccatcgaggtgccatcgagccacttgtccctggtttcccacgccaaggaaatcaccgacctgatcctcgaagcgtccggccgccagccttaa

SEQ ID NO: 2202 - DNA, 771 bp, Pseudomonas sp.
atgaaacctgcaagcaaactctgcctggtcgccgccagcctgctgatgctgggcaccggcactgccatggccggcaccgtcgcgccggtcaaagccaataacgtggtgctggtacatggctcctgggctgacgggtcgagctggtccgaggtgattacccgcctccaggccgccgggctgcacgtcactgccgtgcagaacccgctgacctcggtggccgacgatgtcgccgccaccaaccgtgtactggatcaacaagacggccctaccgtgttggtcggccattcctacgccggcaccgtggtcagcgacgccggagccaacccgaaagtcagttcactggtctacgtggccgcccgggctccagatgccaacgaagacttcgtcgcgctctcagccaagtatccgaccatgccggtgcgcgccggtgtcgaagatcacgacggctacctcaccctgagccaggacgccttcctcaagtatttcgccaccgatgtgccgcacgcgaaggccatggagctgtacgccgtgcagcaacccatcacaaaggccctgttcagcggccgcactgtcaatgcggcctggcataccaagccgtcttggtacgcggtgtccgcaaatgaccagaccatcaacccagaccttgagcgctttctcgccaagcgcatgaatgccaccactgtcgagctgccatcgagccacttgtcactggtgtcccacgccaaggaaatcaccgacctgatcctcgaagcctcgggccgccagccctaa

SEQ ID NO: 2203 - DNA, 771 bp, Pseudomonas sp.
atgaaacctgcaagcaaactctgcctgatcgccgccagcctgctgatgctgggcactggcaccgccatggccgccaccgtcgcgccggtcaaagccaataacgtggtgctggtgcacggttcctgggccgacggttcgagctggtccgaggtgatcacccgcctccaggccgccggcctgcacgtcactgccgtgcagaacccgctgacttcggtggccgatgatgtcgccgccaccaaccgcgtgctggcccaacaagatggccctacggtgctggtcggccattcctacgccggtaccgtggtgagcgacgccggggtgaacccgaaagtcagcgccctggtgtacgtagccgcacgtgcaccggacgccaatgaagacttcgtcgccctctcggccaagtacccgaccatgcctgtgcgggccggtgtggaagatcatgacggctacctcactctgagccaggacgccttcctcaactacttcgccgccgatgtgccgcgcgccaaggccctggcgctgtatgccgtgcagcaacccatcaccaagaccctgttcagcggccgcaccgtcaatgccgcctggcacaccaaaccgtcctggtacgcggtgtcggcgaatgaccaaaccatcaatccagacctggagcgcttcctcgccaagcgcatgaacgccaccaccattgagctgccttcgagccacttgtcgctggtgtctcacgccaaggaaatcaccgacctgatcctcgaagcgtctggccgccagccctga

SEQ ID NO: 2204 - DNA, 771 bp, Pseudomonas sp.
atgaaacctgcaagcaaactctgcctgatcgccgccacgctgctgatgctgggcactggcaccgccatggccggcactgtcgcgccggtcaaagccaataatgtggtactggtgcacggttcctgggctgacggctcaagttggtccgaggtgattacccgcctccaggccgctgggctgcacgtcactgccgtgcagaacccactgacctcggtggccgacgatgtcgccgccaccaaccgtgtgctggatcagcaagacggccctaccgtgttggtcggccattcctacgcaggcaccgtggtcagcgacgccggagtcaacccgaacgtcagcgccctggtctacgtggccgcccgggctccagatgccaacgaagacttcgttgcactctcggccaagtacccgaccatgcctgtgcgcgccggcgtcgaagatcacggcggctacctcaccctgaaccaggacgccttcctcaagtatttcgccgccgacgtgccgcgcgccaaagccatgcagctgtatgccgtgcagcaacccatcaccaagacgcttttcagcggccgcaccgtcaatgccgcctggcacaccaagccgtcttggtacgcggtgtcggcaaacgaccagactatcaacccggacctggagcgcttccttgccaaacgcatggacgccaccaccatcgagttgccatcaagccacttgtcgctggtatcccacgccaaggaaatcaccgacctgatcctcgaagcctcgggacgccagccttaa

SEQ ID NO: 2205 - DNA, 771 bp, Pseudomonas sp.
atgaaacctgccagcaaactctgcctgatcgccgccagcctgttgatactgggtaccggcaccgccatggccggcactgtcgcgccgatcaaggccaacaatgtggtgctggtgcacgggtcctgggctgacggctcgagctggtccgaggtgatcacgcgcctgcaggccgccgggctgcatgtgaccgccgtacaaaacccactgacttcggtggccgatgacgtcgctgccaccaaccgcgtgctggaccaacaggacggccctaccgtgctggtcggtcactcctacgccggcaccgtggtcagcgacgccggggcgaaccccaaggtcagctcactggtgtacgtggccgcccgtgcaccggacgccaacgaagacttcgtcgccctgtctgccaaataccccagcacgccggtgcgcgccggtgtcgtcgagcacgacggttacctgacgctgaaccaggacgccttcctcaagtacttcgccgctgacgtgccgcgcgccaaagccctgcagctgtacgcggtacaacagccgatcgccaagaccctgttcaacggccgcacggtgaatgccgcctggcacaccaagccgtcctggtacgcagtgtcgagcaatgaccagaccatcaacccggacctggagcgttttctggccaagcgcatgaacgcgaccaccatcgaactgccgtcgagccacttgtcgctggtatcccacgccaaggcaatcaccgacctgatcctcgaagcgtccggccgccagccttaa

SEQ ID NO: 2206 - DNA, 783 bp, Pseudomonas sp.
atgaaacctgcaagcaaactctgcctgatcgccaccagcctgctgatgctgggcacgggcacggcactggccggcactgtcgcgtcggtcaacgccaataacgtagtgctggtgcacggttcctgggctgacggttcgagttggtccgaggtgatcacccgcctccaggccgccggcctgcacgtcaccgccgtgcagaacccgctgacctcggtggccgacgatgtcgccgccaccaaacgtgtgctggaccaacaggacggccctaccgtgctggtcggccattcctacgccggtacggtagtaagcgatgccggagtcgacccgaaagtcagcgccctggtgtacgtggccgcccgcgcaccggacgccaatgaagacttcgtcgcgctctccgcccagtacccgagcatgccggtgcggtctggcgttgaagatcacgacggctacctcaccttgagccaggacgccttcctcaagtacttcgccgccgatgtaccgcaggccaaggccctggcgttgtacgccgtgcagcaacccatcaccaagaccctgttcagcggccgcaccgtcaatgccgcctggcacaccaagccgtcctggtatgcggtgtcggcaaatgaccagacgatcaacccggacctcgagcgcttcctcgccaagcgcatgaacgccacgaccatcgagttgccgtcgagccacttgtcgttggtgtcccacgccaaggaaatcaccgacctgattctcgaagcctctggccgcccgcccgaagccctgcattaa

SEQ ID NO: 2207 - DNA, 819 bp, Pseudomonas sp.
atgacgccacttcctactgatgaaaaggggtaccccatgaaacctgcaagcaaactctgcctgatcgccgccagcctgctgatgctgggcacgggcacggcactggccggcactgtcgcgtcggtcaaagccaataacgtagtactggtgcacggttcctgggctgacggctccagttggtccgaggtgatcacccgcctccaggccgccggcctgcacgtcaccgccgtgcagaacccgctgacctcggtggccgacgatgtcgccgccaccaaacgtgtgctggaccaacaggacggccctaccgtgttggtcggccattcctacgccggtacggtagtaagcgatgccggagtcgacccgaaagtcagcgccctggtgtacgtggccgcccgcgcaccggacgccaatgaagacttcgtcgcgctctccgcccagtacccgagcatgccggtgcgggctggcgttgaagatcacgacggctacctcaccttgagccaggacgccttcctcaagtacttcgccgccgatgtaccgcaagccaaggccctggcgttgtacgccgtgcagcaacccatcaccaagaccctgttcagcggccgcaccgtcaatgccgcctggcacaccaagccgtcctggtatgcggtgtcggcgaatgaccagacgatcaacccggacctcgagcgcttcctcgccaagcgcatgaacgccacgaccatcgagttgccgtcgagccacttgtcgctggtgtcccacgccaaggaaatcaccgacctgatcctcgaagcctctggccgcccgcccgaagccctgcattaa

SEQ ID NO: 2208 - DNA, 777 bp, Collimonas sp.
atgaaaacccgcgttaaactttccctgatcgccttcagcctggccgcaaccgcgttcggttccacgccagtgttcgcgcaatcggcggttccacccaaggcggtcaacgtggttctggtgcatggcgcctgggccgacggctccagctgggccaatgtgattccgcgcctgcaggccgccggcctgaacgtcacgtcggtgcagaatcccctgacgtcgctggcggatgatgtcgccgcaacccgccgcgtgctggcgctgcagaacgggccgacggtcctggtcggtcattcctgggccggcaccatcgtcagcgaggcgggggacgatcccaaagtcaccaccctggtgtatgtagcagcgcgtgcgccggacgccggcgaggatttcaatgccctggccgccaggtatccaaccatgccggtgcgcgccggggccaaggatcacgatggttatgtgacgctgaccgaggatgcttatcttaagtatttcggcggcgacctgccgcacgaccaggcgctgtccttgtatgccacgcagcagccgattgccaagaccctgttcagcggccgcaccaccgtcgcggcatggcacgacaagccatcctggtatgcggtgtcgaagcaggaccagaccacctcgcccgatctggaacgcttcctggcgcaacgcatgcatgcgaccacgatcgaactggattccagccacctgtcgctggtgtcgcaccccaaggaaattgccgacctgatcctggcggcggcggggcgtacgcagtag

SEQ ID NO: 2209 - DNA, 1434 bp, Pseudomonas sp.
atgacttttttgcgccctaccctgctgacgctcgcttgcctgctcgcctcaccgggcttcgccgacgacttgccgtcactcggtgacgccagttctgccatcgtctcgccacaacaggaacaccaattgggccgtgcatggctggcgctgttgcgcagtcaggtgtcacagctcaacgatccgcagctcaaggattacgtcgaatccagcgtctaccggctggtggaaaccagccaggtcaatgaccggcgcctggagttcatcctgatcaacagcccgcagctcaacgcttttgctgcgccaggcgggattgtcggcgtcaacgggggcttgttcctcaatgcccagaccgagggtgaatatgcttcggtaatggcccacgaactggctcacttgtcgcagcgtcacttcgcccgcggtgtcgaagcgtcgcaacgcatgcaagtgcccatgatggctgcgctgctggccggcatcgtgattgccgcggccggtgcaggcgatgccgggatcgcagccattgccggcactcaggcggcggcgattcaggaacaacgacgcttctcgcgccagaacgaacaggaagccgaccgtatcggcatcatgaatctggaaaaggccggttacgatccgcgttcgatgccgaccatgttcgaacggctgatgcgccagtaccgcttcgacgccaagccaccggagttcctgttgactcacccggtgaccgaatcgcgaatcgccgacacccgcaaccgcgccgaacaggccaaaccgggcggtatcgaagacagcatgcgttaccagctgattcgggcgcgcgtgcagctgatctatgaagaaaccccgggccttggcgccaagcgctttcgggctcaactcgatgaaaacccgaaaaacgacgtggcgcgctatggcctggcgatcgcccagatcaagggcggccagttgaatgaagctcgcgagaacctcaagctgctgttggccaaatcgccgaatgagatcatctacaacctggcgcaggtcgatctggacatcaccaataatcgtctgcccgatgctcaatcacgggtcgaccggatgctcactcaataccccggcaactacccgctgaatcaggtgcgtgtcgacctgctgctcaagcagaatcgagcgagcgatgcggaaaaagcgctggaaaccctgctcaagagccgacccgatgatccggacgtctggtacatggtggccgagactcgtggcctgtcgggcaacatcatcggtctgcatcaggctcgtgcggagtactttgcgctggtcggcgactatcgccaggcgatccagcaactggacttcgccaagcgcaaggctggcagcaacttcccgctgtcatcgcggatcgacgcacggcaacgggagttgatggagcaggaacgcatggtcaaggacatgatgggctga

SEQ ID NO: 2210 - DNA, 1434 bp, Pseudomonas sp.
atgacttttttgcgccctaccctgctgacgctcgcttgcctgctcgcctcaccgggcttcgccgacgacctgccgtcactcggcgacgccagttctgccatcgtctcgccgcagcaggaataccaattgggccgcgcatggctggcgctgttgcgtagccaggtttcgcagctcaatgacccgcaactcaaagactatgtcgaatccagcgtttaccgcctggtggaaaccagccaggtcaatgaccgacgccttgagttcattttgatcaacagcccgcaactcaacgcattcgccgcgccggggggcattgtcggtgtcaacggcggcttgttcctcaacgcccagaccgaaggtgaatatgcctcggtaatggcgcacgaactggctcacttgtcgcaacgccactttgcccgtggcgtcgaagcccaacagcgcatgcaagtgccaatgatggccgcgttgctggccgggatcgtgattgctgctgccggtgccggcgatgccgggatcgcggccattgcgggtacgcaggcggcagcaattcaggagcagcgccgcttctctcgccagaatgaacaggaggccgaccgtatcggcatcctcaacctggaaaaagccggctacgacccgcgctcgatgccatccatgttcgagcgactggggcgccagtaccgctttgatgccaagccaccggaattcctgctgactcacccggttaccgaatcgcggatcgccgatacccgcaaccgcgccgaacaggcgcgacaagggggtatcgaagacactgtgcgctatcaacttattcgcgcacgggtgcaattgatctacgaagaaacaccaggtctgggcgccaagcgctttcgcgcgcagctggatgaaaacccgaaaagtgatgtcgctcgttatggattggccattgcacagatcaagggcgggcagcttaacgaagcacgggaaaatctcaaattactgctgaccaaggcgccaaacgagatcatatacaacctcgcccagattgatctggacatcaccaacaatcgtttggccgatgcacagacgcgggctgaccggatgctgtctcagtatccaggcaactatccgctgaatcaggttcgcgtggatctgctgctgaagcagaaccgcgccgccgatgctgaaaaagcactggaaagcctgctcaaatcgcggccggacgatccggacgtttggtatcaagtggccgaaactcgtggcttgtcgggcaacatcatcggcctgcatcaggcacgcgccgaatactttgcgctggttggcgactaccgccaggccatacagcaacttgatttcgccaagcgcaaggccggcagtaacttcccgctgtcgtcgcgcatcgatgcccgccagcgagagctgatggaacaggagcgcatgatcaaggacatgatggggtag

SEQ ID NO: 2211 - DNA, 1434 bp, Pseudomonas sp.
atgacatttttgcgccctaccctgctgacgctcgcttgcctgctcgcctcaccgggcttcgccgacgacctgccgtcactcggtgacgccagttctgccattgtctcaccgcaacaggaataccagctcggccgtgcctggctggccatgttgcgcagtcaggtttcgcagctcaacgatccgcaactcaagaattacgtggaatccagcgtttaccgactggtcgagaccagccaggtcacagaccggcgcctggaattcatcctgatcaacagcccgcagctcaacgcctttgcggcacccggcgggatcgtcggggtgaacggcggcttgttcctctacgcccagaccgaaggcgaatacgcttcagtactggcgcacgaattggctcacttgtcgcaacgccactttgcccgaggcgtcgaagcacagcaacgcatgcaagtacccatgatggctgcattgctggcgggtatcgtgttggcagccgcaggtggcggtgacgccgggattgcagccattgccggcacacaggccgcagccatccaggaacagcggcgattctcccgccagaacgagcaggaagccgaccgtatcggcatcctcaatctggaaaaggccggttacgatccccgctcgatgccaacgatgttcgagcgtctggggcgtcagtaccgctacgatgccaagccaccggaatttctgctgactcacccggtcaccgaatcgcgtatcgccgacacccgcaaccgcgccgaacagtttccagcgggcggtatcgaagacagcatgcgctaccaactgatccgcgcacgcgtacagctgatctatgaagaaaccccgggtcttggcgccaagcgctttcgcgcacagctcgacgagaacccgaaaaacgacgtggctcgctacggcctggcgatcgcccagatcaagggcggccaactgaacgaagcacgggaaaacctcaagcagttgctggccaagtcacccaacgaaattatctacaacctggctcaggtcgatctggacatcaccaacaatcgcctggcggacgcccagtcccgggttgaccggttgatgggccaatactctggcaactacccgctgaaccagatgcgcgtcgacctgctgctcaagcaaaaccgtaccgcggatgcggagaaagccctcgaaggcctgctcaagtcgcgcccggatgatccggacgtgtggtatcaggttgccgaaacgcgcggcctgtcgggcaatatcatcggcctgcatcaggctcgcgccgaatactttgcactggtcggcgactacaaacaggccattcagcaactggacttcgccaaacgcagggctggcagcaacttcccgctgtcttcgcggatcgacgcgcgacaacgcgagctgatggagcaggagcgcatgatcaaggacatgatgggctga

SEQ ID NO: 2212 - DNA, 1434 bp, Pseudomonas sp.
atgacatttctgcgccccaccctgctgacgctcgcttgcctgcttgcctcaccgggcttcgccgacgacctgccgtcactaggcgacgccagttctgccatcgtctcgccagaacaggagcaccaactgggccgcgcctggttggccctgctgcgcagccaggtttcacagctcaacgatccacagctcaaggactacgtcgaatccagcgtctataaactggtggaaaccagccaggtcaacgaccggcgcctggagttcatcctgatcaacagcccgcagctcaacgccttcgccgcaccaggcggaatcgtcggggttaacggcggcctgttcctcaatgcacagaccgaaggcgaatacgcctcggtcatggcccacgaactggcgcacttgtcacaacgccacttcgcccgcggcgtcgaagcccagcagcgcatgcaggtaccaatgatggccgcgctgctggccggtatcgtgattgccgccgccggtggcggtgacgccgggatcgcggctatcgccgggacccaggctgcggccatccaggaacaacggcgtttctcgcgccagaacgaacaggaagccgaccgcatcggcatccagaacctggaaaaggccggctacgatccacggtccatgccaaccatgttcgaacgcctgatgcgccagtaccggttcgacgccaggcccccggaattcctgctgactcacccggtaaccgaatcccggatcgccgacacccgcaaccgcgccgaacaggccaagccgggcggtatcgaggacagtgtgcgctatcaactgattcgcgcacgggtccagttgacctacgaagaaaccccgggcctggccgccaagcgcttccgggcgcagctggatgagaacccgaagaacgacgtggcgcgctatggcctggcaatcgcgcagatcaagggcggccagttgaacgaagcacgggaaaacctccagccgttgctggccaaatcgcccaacgagatcatctacaacctcgcccaggtggacctggacatcaccaacaacaaactggccgacgctcaatcgcgcgtcgagcggatgctgagccagtacccgggcaactatccgctcaaccaggtacgcgtcgatctgctgctcaagcagaaccgccccgccgatgccgagaaggccctggaatccttgctcaagacccgcccggacgatccggacgtctggtacatggtggccgagacccgcgggctgtcgggcaatatcatcggcctgcatcaggctcgtgccgagtacttcgcactggtaggcgactaccgtcaggccatccagcaactggacttcgccaaacggcgcgccggcaccaacttccccctgtcgtcacgcatcgatgcccggcagcgggagctcatggagcaggaacgcatggtcaaggacatgatgggctga

SEQ ID NO: 2213 - DNA, 1434 bp, Pseudomonas sp.
atgacttttttgcgccctaccctgctgacgctcgcttgcctgctcgcctcaccgggcttcgccgacgacctgccgtcactcggcgacgccagttctgccattgtctcaccgcaacaggaataccagctcggccgcgcctggctggccatgttgcgcagtcaggtttcacagctcaacgatccgcaactgaagaattacgtggaatccagcgtctaccgactgttggagaccagccaggtcactgaccggcgcctggagttcatcctgatcaacagcccgcagctcaacgcctttgcggcacccggcgggatcgtcggggtgaacggtggcttgttcctctacgcccagaccgaaggcgagtacgcctcggtactggcgcacgaactggctcacttgtcgcaacgccactttgcccggggcgtcgaagcgcagcaacgcatgcaagtccccatgatggctgcattgctggcgggtatcgtggtggcagccgcaggtggcggtgacgccgggattgcagccattgccggcacacaggccgccgccctccaggagcagcggcgattctcccgccagaacgagcaggaagccgaccgtatcggcctcctcaatctggaaaaggccggttacgacccccgctcgatgcccagcatgttcgagcgcctggggcgtcagtaccgctacgacgccaagccaccggagtttctgctgactcacccggtcaccgagtcgcgtatcgccgacacccgcaaccgcgccgaacagtttccagcgggcggtatcgaagacagcatgcgctaccaactgatccgcgcacgcgtacaactgatctatgaagaaaccccggggcttggcgccaagcgctttcgcgcgcagctcgacgagaacccgaaaagcgacgtggcacgctacggcctggcgatcgcccagatcaagggcggccgactgaatgaagcacgggaaaacctcacgcagttgctggccaagtcacccaacgaaatcatctacaacctggctcaggtcgatctggacatcaccaacaatcgcctggcggatgcccagtcccgggttgaccggttgatgggccaatactccggcaactacccgctgaaccagatgcgagtcgacctgctgctcaagcagaaccgtactgcggatgcggagaaagccctcgacggtctgctcaagtcgcgcccggatgatccggacgtgtggtatcaggttgccgagacgcgcggcctgtcgggcaacatcatcggcctgcatcaggctcgcgccgaatactttgcgctggtcggggactacaaacaggccattcagcaactggacttcgccaaacgcagggccggcagcaacttcccgctgtcttcgcggatcgacgcgcggcaacgcgagctgatggaacaggagcgcatgatcaaggacatgatgggctga

SEQ ID NO: 2214 - DNA, 1434 bp, Pseudomonas sp.
atgacttttttgcgccctaccctgctgacgctcgcttgcctgctcgcctcaccgggcttcgccgacgacctgccatcactcggtgacgccagttctgccattgtctcgccgcaacaggaataccagctgggccgcgcctggctcgccctgctgcgcagtcaggtttcgcaactcaacgacccgcaactcaaggactacgtcgaaaccagcgtctacaaactggtggaaaccagccaggtcaatgaccggcgccttgagttcattctgatcgacagcccgcaactcaacgccttcgccgcacccggcgggatcatcggggtcaacggcgggctgttcctcaacgctcagaccgaaggcgaatatgcctcggtactggcccacgaattggctcacttgtcccaacgccacttcgcccgaggcgtcgaagcccagcaacgcatgcaagtgccgatgatggcagccttgctggccggcatcgtgatcgctgcggccggtgccggcgacgccgggatcgccgccatcgccggcacccaggctgcggccatccaggagcaacgacgcttctcccggcagaacgaacaggaagccgaccgcatcggcatcctcaacctggagaaggccggctacgacccgcgctcgatgccgagcatgttcgaacgcctgatgcgccagtaccgcttcgatgccaagccgccggaattcctcctgactcacccggtcaccgaatcgcggatcgccgacacccgcaaccgcgccgagcaggccaagcccggcggcaccgaagacagcatgcgctatcagttgattcgcgcgcgggtgcaactcacgtatgaagattcgccgggcctggccgccaaacgctttcgcgcccaactcgacgaaaatccgaaaaacgacgtggcccgctatggcctggccatcgcccagatcaagggcagccaatggaacgacgcgcgggagaacctcaagcagctgttggccaaatcgcccaacgacatcacctataacctggcacagatcgagctggacatcgccaacaaccgcctgcccgatgcacaagcccgggttgaccgagtgctgacccaatacccgaacaactatccgctgaatcaggttcgggtcgacctgctgctcaagcagaaccgcgccgccgacgccgaaaaagccctcgaaggtctgctcaagagccgccccgacgatccggacgtatggtacatggtggcggaaacccgcggtctgtctggcaataccatcggcctgcaccaggcccgcgccgagtacttcgccctggtcggtgactaccgtcaggccatccagcaactggacttcgccaaacgtcgcgcgggcagcaacttcccgctgtcctcgcggatcgatgcccgccagcgcgagttgatggaccaggaacaaatggtcaaggacatgatgcgctga

SEQ ID NO: 2215 - DNA, 1434 bp, Pseudomonas sp.
atgacttttttgcgccctaccctgctgacgctcgcttgcctgctcgcctcaccaggcttcgccgacgacctgccgtcactcggtgatgccagttctgccattgtctcgccccaacaggaacaccaactgggccgcgcctggctggcgttgctgcgcagccaggtttcgcaactcaacgacccgcaactcaaggattacgtcgagaccagcgtctacaagctggtcgagaccagccaggtcaacgaccggcgtctcgagttcatcctgatcaacagcccgcagctcaacgccttcgccgctcccggcgggattgtcggggtcaacggcgggctgttcctcaacgcccagaccgaaggcgaatacgcctcggtactggctcacgaattggcacacttgtcgcaacgtcacttcgcccgtggcgtcgaggcctcgcaacgcctgcaggtgccgatgatggccgccctgctggccggtatcgtgatcgccgcggcgggtggtggcgacgccggaatcgccgccattgccggcacccaggccgcggccatccaggaacaacggcgcttctctcggcaaaacgagcaggaagccgaccgtatcggcatcctcaacctggaaaaggccggttatgacccgcgctccatgccgaccatgttcgaacgcctgatgcgccagtaccgcttcgacgccaagccgccggagttcctgctgactcacccggtcaccgaatcgcggatcgccgacacccgcaaccgtgccgaacaggccaaggctggcggcaaggaagacagcctgcgctaccagctgatccgcgcacgagtacagttgatctacgaagagtctcccggcatgggcgccaagcgtttccgtgcccagctcgacgaaaacccgaaaaacgatatcgcccgctacggcctcgccatcgcccagatcaagggcagccagttcaacgatgccagggaaaacctcaagcagctgctggccaagcagcctaacgacatcacttacaacctggcccagatcgatctggataccgccaccagccgcttttccgacgcccaggcccgggtggacaaaatgcttgcgcagtacccgggcaactatccactgaaccaggtcagggtcgatctgctgctcaagcagaatcgcccggcggacgccgaaacggccttggaaagcctgctcaagacccgctccgatgatccggacgtctggtactcggtggcggaaacccgcggcctgtccggcaacatcatcggcctgcatcaggcgcgggccgaatactttgccctggtcggcgactatcgccaggcgatccagcagctggatttcgccaaacgtcgcgccggcagcaacttccccctgtcttcgcggatcgatgcccgtcagcgtgagctgatggaccaggagcaaatggtcaaggacatgatgcgctga

SEQ ID NO: 2216 - DNA, 1434 bp, unknown
  environmental sample
atgacttttttgcgccccaccctgctgacgctggcttgcctgctggcctccccaggcttcgccgacgacctgccgtcacttggcgacgccagttctgccattgtctcgccacaacaggaataccagttgggtcgcgcatggctggcctacctgcgcgggcaggtctcgcaactgaacgacccgcagctcaaggattatgtcgaaaccagcgtgtacaaactggtggaaaccagccaagtcaatgaccggcgcctggagttcatcctgatcaacagcccgcaactcaacgcctttgcggcgccaggcggcattgtgggggtgaacggcgggctattcctcaacgcccagaccgaaggggaatatgcctcggtactggcccatgaactggcgcacttgtcccagcgtcacttcgcccgtggcgtggaagcgcagcagcgcatgcagatcccaatgatggcagcgctgcttggcggcatcattgcggcggcggccggtgctggcgatgccggcatcgcggcgattgccggcacccaggccgccgcgatccaggaacagcgcaggttctctcggcaaaatgaacaagaggccgaccgcatcggtatcgtcaatctggaaaaggccggctacgacccacgctcgatgccgaccatgttcgagcgcctgggccgccaataccgcttcgacgccaagccaccggagttcctgctgacgcacccggtcaccgaatcacggatcgccgacactcgtaaccgtgccgaacaagccaaacccggcggcaaggaagacagcctgcgctatcagttgattcgcgcacgggtgcagttgcagtacgaagacacgtcaggcctggccgccaagcgtttccaggcgcagctggacgagaacccgaagaacgatgtagctcgttacggcctggccatcgcccagatcaaagcctctcagttcaagcaggcgcgggacaacctggcaccgctgctggccaagacaccaaacgacatcacctacaacctggcgcagatccaactggatatcgacaacaatcgcctgcctgatgcccagcaacgcacggatcggctgctcacccagtaccccggcaactatccgctgaaccagattcgggtcgacctgttgctcaagcagaaccgtacggccgatgccgagaaagccctggatgcactgctcaaatcccgtcccgacgaccccgacgtctggtaccaggtcgccgaaacacgcggcttgtccggcaacatcattggcctgcatcaagcgcgcgccgagtatttcgcgctggtgggcgatttccagcaggcgatccagcagttggattttgccaagcgcagggccgggagcaatttccccctgtcttctcgtatcgacgcacgccagcgtgagctgatcgaacaggaacgcctggtcaaaggcatgatgagctaa

SEQ ID NO: 2217 - DNA, 1434 bp, Pseudomonas sp.
atgacttttttgcgccccaccctgctgacgctggcttgcctgctggcctctccaggcttcgctgacgacctgccgtcgcttggcgacgccagttctgccattgtctcgccacaacaggaattccaactgggccgtgcctggctggcctacctgcgcggacaggtttcccaactgaacgacccgcaactcaaagattacgtcgaaaccagcgtgtataagctggtagaaaccagccaggtgaacgaccgacgcctggagttcatcctgatcaacagcccgcaactcaacgcgtttgccgcgccaggcggtattgtcggcgtgaacggcggcctgttcctcaacgcccagaccgaaggagaatacgcctcggtgctggcgcacgaattggctcacttgtcacagcgtcacttcgcccgtggcgttgaagcgcagcagcgcatgcagatcccgatgatggctgctctcctcggtggcatcatcgcggcagccgccggcgcaggtgatgcgggcattgctgcgatcgccggcacccaggcggcggcgatccaggaacaacggcggttctctcggcagaatgaacaagaggctgaccgtatcggtatcgtcaatctggagaaagccggctacgacccgcgctccatgccgaccatgttcgagcgattggggcgtcaataccgcttcgacgccaagccaccagaattcctgttgacgcacccggtcactgaatcgcggatcgccgacacccgaaaccgagccgagcaatccaagcccggcggaaaggaagacagcctgcgctatcaactgattcgcgcacgggtgcagctgcaatatgaggacacctcaggactcgccgccaaacgcttccaggcgcaactggacgagaatccgaaaaacgatgtggcgcgttatggcctggccatcgcccaaatcaaggcctcacaattcaagcaagcgagagatagcctgcaaacgctgctggccaaagcgcccaatgacatcacttataacctggcgcaaatccagctggacatagacaacagccgtctagccgacgcccagcaacgcacggatcggatgctgacccaataccccggcaactatccgctgaatcagatccgagtcgacctgctgcttaaacaaaatcgtaccgcggatgcggaaaaggccctggatggcctgctcaagtctcgtccggacgatccggacgtgtggtatcaagtcgccgagacacgcgggttatccggcaacatcatcggcctgcaccaggcgcgcgctgaatactttgctctggtgggcgacttccagcaggcgatacagcaactggacttcgccaaacgccgcgccggcagtaactttccattgtcgtcacgtatcgacgcacgccagcgtgagctgatcgaacaggaacgcctggtaaaagggatgatgagctaa

SEQ ID NO: 2218 - DNA, 1431 bp, Pseudomonas sp.
atgaattttctgcgcccgaccctgttgacgctcgcttgcctgctcgcatcaccgagtttcgcagacgatttaccgtctctgggtgacgctagctcggccatcgtttcccctgcgcaagagtaccaactgggccgtgcctggttgagcatgctgcgcagtcaggtggcgcagctcaacgacccgcaactcaaggactacgtcgaaaacagcgtttacaagctggtggagaccagtcaggtacaagaccgacggctcgaatttattctgatcgacagcccgcagctcaacgcctttgcggcacctggcgggattattggggttaacggcgggctgtttctgaacgcccagaccgagggcgaatatgcctcggtgatggcccacgaacttgcccacttgtctcaacgccacttcgcccgcggggtagaagcccagcaacgcatgcaactgccaatgatggcggccttactcgccggcattgtattggcagcctccggcgccggtgatgccggcattgccaccattgcgggtactcaagcggcggcgtttcaggaacaacggcgtttctcgcggcagaacgagcaagaggctgaccgcatcggcattctcaacctcgaaaaggccggttacgacccacgttccatgcccaccatgtttgagcgcttgatgcgtcaataccgcttcgatgccaagccgccagagttcttgctgactcacccggtgaccgagtcgcgtatcgctgacacccgcaaccgtgccgaacaagccaagatcggcggcaccgaagacagcctgcgctatcaactgattcgtgcccgcgtgcaactgcaatacgaagacaccccaggcttggcggccaagcgctttcgccagcaactcgacgaaaacccgaaaaacgacgtagcgcgttatggcctagcgattgcgcaaatcaagggcagtcaattcaacgacgcccgcgccaacttaaagcccctgctcgacaaggcgcctaacgacatcacctacaacttggcgcaaatccaactggacatggacagcaaccgcctggcagatgcccagcaacgaatcgacagaatgcgcacactgtacccgggtaattacccgttgaatcaggctcgggttgatttgctgctcaagcaaaaccgtccggccgatgcggaaaaagccctagaagcactgctgaaaagtcgcccggatgatccggatgtctggtatttggtcgcagaaacacgcgggttgtcgggcaacatcattggcctgcatcaggcccgagccgagtactttgccttgatgggtgactatcgcaaggccattcagcaaatcgcttttgctaaaaagctcaccaacaacttccagctgtcgtcacgccttgatgcgcgccagcgagagttgatggatcaggagcgggcgattaaagacatgatgaactga

SEQ ID NO: 2219 - DNA, 1431 bp, Pseudomonas sp.
atgacttttctgcgcccgaccctgttgacgctcgcttgcctgctcgcatcaccgagtttcgccgacgatttgccgtcgctgggtgatgccagctcgtccatcgtatcgccgcagcaggagtatcaactgggtcgcgcctggttgagcatgcttcgtggtcaggtctcgcagcttaacgatccacaactcaaagactacgttgaaaccagtgtttacaagttggtggagacaagccaggtccaggatcggcgcctggaattcattctgatcaacagcccgcagctcaacgcctttgccgcgcctggtgggattatcggggtcaacggcggactgtttctcaacgcgcagaccgaaggcgaatacgcctcggtactggcccacgaattggcccacttgtcgcaacgtcacttcgcacgcggtgtagaagcccagcaacgcatgcaaatgccgatgatggccgccttactcgccgggattatcgttgccgctgcgggcgcaggtgacgcagggatcgccgccattgccggcacccaggcagcagccatgcaagagcagagacgcttttcgcggcagaacgaacaagaagcggaccgtatcggcattcttaatctggagaaagcaggctacgacccacgctccatgccgaccatgtttgaacgcctgatgcgccaataccgttttgacggacgtccacctgagtttttgctgactcacccagtgacagaatcgcgcatcgccgacacccgcaaccgcgccgagcaagccaaactcggcggcaccgaagacagtctgcgctatcaactgatccgcgcccgcgtccagctcaactatgaagaaacccccggcctggccgccaagcgttttcgcgtcttgctcgatgaaaacccgaaaaacgatgtcgcccgctatgggttggcgatcgcccaaataaaaggcagccaatttaacgaagcacgtgaaaatctaaaaatactgctggaaaagtcgcccaacgacatcacgtataacctggcgcaaattgaactcgacacggccagcaaccggttggccgaagcccaacagcgtgtcgaccggatgcgcacgctgtatccgggtaactatccgctcaatcaggcgcgcgtcgacctgctactcaagcaaaaccgcccgggcgaggctgacaaagcactcgaagcactgctcaaaagtcgccccgacgacccggacgtgtggtactcggtagcagaaacccgagggctgtcgggcaacatcatcggcttgcaccaggcgcgcgctgaatacttcgcattggtgggggattatcggcaagcactgcaacagctggagttcgccaaaaaactcaccaacaacttccagctgtcatcgcgcattgatgcccgtcaacgcgatttgctcgaccaagaaagagccatcaaggaaatgatgaactga

SEQ ID NO: 2220 - DNA, 1431 bp, Pseudomonas sp.
atgacttttctgcgccctaccctgttgacgctcgcttgcctgctcgcctcgccgagcttcgccgacgatttaccgtccctgggtgacgccagttcgtccatcgtctctccacaacaagagtaccaactgggccgcgcctggttgagcatgctgcgcagccaggtgtcgcaactcaacgacccgcagcttaaggattacgtcgaaaccagcgtctacaaactggtcgaaaccagccaggtacaggaccgccgactggaattcatcctgatcaacagcccgcaactcaacgccttcgccgctcccggcggtatcatcggggtcaacggcggcctgttcctcaacgcccagaccgagggcgaatacgcttcggtaatggctcacgaactggctcacttgtcccaacgccacttcgctcgtggcgtagaggcgcagcagcgcatgcaactgccgatgatggctgcactgctcgcaggaatcatcgttgcggcttctggcgcgggcgacgccggcattgctgctatcgcagggactcaggccgcagccatgcaagaacagcggcgcttttcgcgacagaatgagcaggaggctgaccggatcggcattctcaacctggagaaagcaggctatgacccgcgctccatgcccaccatgttcgagcgcctgatgcgccaatatcgctttgacggtcggccacccgagtttttgctgactcacccggtcactgaatcgcgtattgccgacacccgcaaccgcgccgaacaggcccgagtgggcggcaccgaagacagcttgcgctatcaactgatccgcgcccgagtgcagctcaactacgaagaaacccctggcctggctgccaagcgctttcgccagcagttggatgagaacccgaaaaacgacgtagcccgttatggtctggcgattgcctacatgaaaggcagccagttcaacgaagcccgcgacacgctcaagccgttactggaaaagtcgccgaacgacatcacctacaacctggcgcaaatcgagctggacatggacagcaatcgcctggccgaagcccaacagcgaatcgacagaatgcgcaccctgtatccgggcaactacccgctcaatcaggcgcgagtcgacctgctgctcaagcaaaacaaacccaaagaagccgacaaagcgcttgaggccctgctcaagagtcgtcccgacgacccggatgtctggtactcggttgcagagacccgaggcttgtctggcaacatcatcggcctgcatcaagcccgtgcggagtactttgcgctggtgggtgactaccgtcaggccatccagcaactggactttgcccagaagctcaccaacaacttccagctgtcagcacgcctggatgcccgcaagcgggaattgatggatcaggagcgggcgctcaaagagatgatgaactga

SEQ ID NO: 2221 - DNA, 1434 bp, Pseudomonas sp.
atgaattttctgcgccctaccctgctgacgctggcctgtttgatggcgctccccagccatgccgacgacctgccgtcactcggcgacgccagttctgccattgtctccccgcaacaggaacaccagctgggccgcgcctggctcagcctgctgcggggcaatgtcaaccaactgaacgatccccagctcaaggattacgtcgaaaccagcgtctaccgtctggccgagaccagccagctacaggaccggcgcctggaggtcatcctcatcgacagccgcgaactcaacgccttcgccgctcccggcgggatcgtcggggtcaacggcgggctgttcctcaatgcccagaccgagggcgagtacgtctcggtattggcccacgaactggcgcacttgtcccagcgccacttcgcccggggcgtcgaggcccagcaacgcatgcaactgccgatgatgggcgcgctgctgatcggtatcgtcgccgccgcagcaggggccggtgatgccggtattgccgcgatcgccggcacccaggccgcagccatccaggaacagcggcgcttctcccggcagaacgaacaggaagccgaccgcatcggtatcctcaacctcgagaaggccggctacgatccgcgcaacatgccgaccatgttcgagcgcctgatgcgccaataccgttatgacgccaagccgccggaattcctcctgacccacccggtcaccgaatcgcggatcgccgacacccgcaaccgcgccgaacaggcgcccaagggcggcaccgaagacagcaagcgttatcaactgattcgcgcgcgggtggcattgatctacgaaggcaccccagggcttgcggccaagcgcttccaggcgcagctcgacgaaaacccgcaacaggacgccgcccgttacggcctggccctggcccagatcaagggcgggcgcctgaacgaggcgcgcgagaacctcaagccgctgctggccaaggcgcccaacgacatcacctacaacctggcgcagatcgacctggacatcaccaacaaccgcttgcccgatgcccagcagcgcgtcgaacggatgcgtggcctgtacccgggcaactacccgttgcaacaggcgcgcatcgacctgctgctcaagcagaaccgccccgccgaggcggaaaaggcgctggatgcgctgctcaagaatcgcccgcaagacccggatgtctggtatgacgtggcggaagtgcgcgggttgtcgggcaacaccattggcctgcaccaggcccgcgccgaatactttgccctggtgggcgacttcgaccaggccttgcaacagctcgattacgctaaacagcgggccggcaacaactttgtcctggcgtcgaagatcgatgcgcgtcagcgcgagctgatggagcagcagcggatggtcaaggacatgatgcgctaa

SEQ ID NO: 2222 - DNA, 1434 bp, unknown
  environmental sample
atgaatccactgcgccccgccctgctgacgctggccttgctgatggccctgccggggcatgccgacgacctgccgtcactgggggatgccagctccgcgatcgtctcgccgcagcaggagcaccagctgggccgtgcctggctcagcctgttgcgcagccaggtacgccagctcagcgacccgcagctcaaggactatgtggagaccagcgtctatcgcctggccgagaccagccagttgcaggaccggcgcctggaattcatcctgatcgacagccgcgaactcaacgccttcgccgcgccgggcggcatcgtcggggtcaacggcgggctgttcctcaatgcccagaccgagggcgaatacgcgtcggtgctggcccacgagctggcgcacttgtcgcagcgtcacttcgcccgcggcgtcgaagcccagcagcgcatgcagatgccgatgatggccgccctgctcgccgggatcgtgctggccgctgccgggggcggcgatgccgggatcgccaccatcgccggcacccaggccgccgcgatccaggaacaacgacgcttctcgcggcagaacgagcaggaagccgaccgcatcggcatccagaacctggaaaaggccggttacgatccacgcaacatgccgaccatgttcgagcggctcatgcgtcagtaccgcttcgatggcaagccgccggaattcctgctgacccaccccgtcaccgaatcgcggatcgccgacacccgcaaccgcgccgaacaggctcccaagggcggcgtcgaggacagcctgcgctatcagctgatccgcgcccgcgtggcgctcacctatgaaggcacccccgggttggcggccaagcgttttcgcgtccagctcgacgagaaccccaacctggatgccgcgcgttacggcctggccctggcgcagatacagggcgggcagttgaacgaggcccgtgcgagcctcaagccgctactggccaaggcgcccgacgacatcacctacaacctggcgcagatcgagctggaaatcaccaacaaccgtctggacgaggccgagcaacgcatcgagcgactgcgcacctcctatcccggcaactacccgctcaagcaggcgcgcgccgacctgctggtcaagctcaagcgcccggccgaggcagagaaggtgctcgaggacctgctcaagagccggtcggacgacccggatgtctggtacgacatggcggaagtgcgaggcctgtcgggcaacaccatcgggctgcaccaggcccgggccgaatacttcgcgctggtgggggatttcgaccaggcgatccagcagctcgacttcgccaagcgccgggcgggcgacaacttccagctggcgtcgcggatcgatgcgcgccagcgcgagatgctggagcaggagcggatggtcaaggacatgatgcgctga

SEQ ID NO: 2223 - DNA, 1437 bp, unknown
  environmental sample
atgaatttcctgcgtccgacattgctcacccttgcctgtctgctggcgaccccgacccttctggccgacgacctgccttcactgggcgattccagctcgtcgattgtctctcctgagcaggagcaccagttgggccgggcatggctgggcatgttgcgttcacaggtcggccagctgtcggacccgcaactgaaggattttgtcgagacatcggtgtacaagctggccgagaccagccaggtgcaggaccggcgcctggagttcatcctcatcaacagcaaccagctcaacgcctttgccgcgcccggcggcatcatcggggtcaatggcggcttgttcctgtatgcccgtaccgagggcgagtacgcctcggtcatggcccacgagctggctcacttgtcacaacgccactttgcccggggtgtcgaagcccagcagcgcatgcaggtgccgatcatggccgccatgctggccggcatcgtcatggccgctgccggcgccggcgacgccggtatcgcgaccatcgccggcacccaggccgccgcaatccaggaacagcgccgcttctcgcggcagaacgagcaggaggccgaccgcatcggcatcctcaacctggaaaaggccggctacgacccgcgcaacatgccgaccatgttcgaacgcctgatgcgccagtaccgcttcgatgccaggccaccggaattcctgctgacccacccggtcagcgagtcacgcatcgccgacacccgcaaccgcgccgaacaagccaaacctggcggccaggaagacagcctgcgctatcaactgatgcgcgcacgggtcgcgttgttctatgaagaaaccccaggcattgccgccaagcgttttcgggcgcaaatggccgagaacccgaacgccgacgacgcccgctacggcctggccatcgcgcagatcaagggtggccagctcaatgaagcgcgggacggccttaagcccttgctggacaaggcgcccaacgaggtcgtgtacaacctggcgcagatcgacctggacatcaccagcaaccgcctggccgaggcgcggcaacgggccgaccgcatgctgacgctgtacccgggcaattacccgctcaaccaggcgcgcatcgatgtgcaactcaagcaaggacgtaccgccgaggccgagaaggcgcttgacgcgctgctcaagcggcgaccggccgatccggacgtctggtatcaggtggccgaggcacgcggcctgaacggcaacaccgtgggcctgcacgaggcacgcgcagaatacttcgcgctggtcggggattttcgccaggccatccagcaactggacttcgccaaacgccgctccaacaataatttccaggtggcctcacgcattgacgcccggcagagagccctggccgagcaggagcgactggtcaagggcatgatgaactga

SEQ ID NO: 2224 - DNA, 1308 bp, Pseudomonas sp.
ttgggccgggcctggctgtccttgcttcgcagccaggtctcgcaactgagtgatccacaactcaaggactacgtcgaaaccagtgtctacaaactggtggagaccagccaggtcaacgaccgacgcctggaattcatcctgatcaacagcccccagctcaacgcattcgccgcaccaggcggaatagtcggcgtcaacggcggactgttcctcaatgcccagaccgagggtgaatatgtctcggtattggcccacgaactggcgcacctttcccagcgccacttcgcccgtggtgtcgaggcgcaacgccggatgcaggtgccgatgatggccgccctgctggccggcatcgtgattgctgccaccggtgccggtgacgctgggatcgccgccatcgccggcacccaggccgcggctatccaggagcagcgacgcttctctcggcaaaacgagcaggaagccgaccggatcggcatcctcaacctggagaaggctggctacgatccgcgctcgatgcccaccatgttcgaacgcctgatgcgccaataccgcttcgacgccaagccaccggagttcctcctgactcacccggtcaccgagtcgcggatcgccgacactcgcaaccgtgccgaacaagccaagcccggcggcatcgaggatagcctgcgctaccaactgatccgcgcacgggtgcaactgaactatgaggaatcgcctggtctggctgccaagcgcttccgtgcccagctcgacgaaaatccaaagaacgacattgcccgctacggcctggccatcgcccagatcaagggcagccagtggaacgaagcccgggagaacctcaagccgctactggccaaatcggccaatgacatcacctacaacctggcccagatcgagctggacatgaacagcaatcgcctgccggacgcacaggcgcgagtggagcgcttgctcggccagtatccgaacaactatccgctgcaccagatccgggtcgacctgctgctcaagcagaatcgtccggccgatgcggaaaaggctctggaaagcctgctcaagagccgccccgacgatccggacgtctggtacctggtggcggaaacccgcggcctgtccggcaacatcatcggcctgcaccaggcacgcgccgagtatttcgccttggtgggggactatggccaggccatccagcagttggatttcgccaagcgccgcgccggcagcaatttcccactgtcgtcacggatcgatgctcgccagcgcgagatgatggatcaggaacagatgatcaaggacatgatgcgctga

SEQ ID NO: 2225 - DNA, 1437 bp, unknown
  environmental sample
atgagattcctgcgccctaccctgctgaccctggcctgcctgctggcagcgccaggccacgccgacgatctgccgatgctcggcgacgccagttccgccatggtcactccgctgcaggagcatcaactgggccgcgcctggctggccctgctgcgctcggaggtgggccagctgtccgacccggaactcaaggaatacgtggaaagcagcgtctatcgcctggcggaaaccagccagttgcaggaccggcgccttgaattcatcctgatcgacagcaaggagctgaatgccttcgccgcgccgggcggtatcgtcggcatcaatggcgggctgttcctcaatgcgcagaccgagggcgaatacgccggggtactggcccacgaactggcgcacttgtcccagcgccacttcgcccgcggcatggaagaacaatccaaggtgcagttgccggtgatggcggcgctgctggcgggcatcgtgatggccgcagcgggggctggcgatgccggggtagcgacgatcttcggcagccaggcggcggcgatccagtcgcaactggcattttcgcggcagcgcgagcaggaagccgaccggatcggcatcatcaacctgcaaaaggccggttacgacccgcgcaacatgccgaacatgttcgagcggttgatgcgccagtaccgcttcgacgccaagccgcccgagttcctgctcacccacccgatcaccgaggcgcgcatcgccgacacccgcaaccgcgccgagcagtttcccgccggtggcgtcgaggacagcctgcgttaccagttgatgcgcgcgcgggtgcagttgatctacgaagacacgcccggcatggcggccaagcgcttccgctcgctgctcgccgaaagcccgcagtcggacgcccagcgctatggcctggcgatcgcgcaaatcaagggcggccagctcaacgaagcgcgggaaaacctcaagccactgctcgccaaggcgcccaacgaaatcacctacaacctcgcgcagatcgcgctggacatcaccaacaatcgcctgcccgacgcccagaagcgggtgaaccagatgctcgacatgtacccggacagctacccgacgaacctggtcagcatcgaattgctgctcaaggaaaaccgcaccgccgacgccgaaaaaggcctcgaggccttgctcaagtcacggcccaatgacccggacgtgtggaacatggtcgccgatacccgtggccagaatggcaacatcatcggcctgcaccaggcccgcgccgagtatttcgccctcaccggcgacttccgccaggctcagcagcagttggatttcgccaagcgccgggccagcgacaatttccaactggcatcgcgcatcgacgcccgccagcgggaattgcaggagcaggagcgcatggtcaaggagttgatgcgaggttga

SEQ ID NO: 2226 - DNA, 1437 bp, Pseudomonas sp.
atgtctttattgcgccccaccctgttgacgcttgcctgcctgctggcactgcctgttcacgctgacgacctgccgtcactgggcgacgccagctcggccattgtctcgccccaacaggaacatgacctgggccgcgcctggctgggcatgttgcgcagccaggttggccagttgtccgacccgcagctcaaggattacgtcgagagcacggtgtatcgcctggccgaaagcagccagttgcaagaccaccgcctggaattcatcctcatcgacagcaaggaactcaacgcctttgcagccccgggcggcattgtcggggtcaacggcgggctgttcctgaacgccgacaccgaaggccagtacgccggcgtaatggctcacgaactgtctcacttgtcacagcgccacttcgcccgcggcgtggaagaacagaaacgcatgcagatgccggtgatggccgcgttgctggccggcatcgtgctggccgccacaggcggcggtgaagccggcatcgccaccatcatgggcagtcaggccgccgccattcagtcacaacgggcgttttcccgcgaaaacgaagccgaggccgaccgcattggcctgattaccctgcaacgggccggctacgacccacgcagcatgccggacatgttcgaaaaattggcgcgccagtatcgcttcgacgccaagccaccggaattcctgctgacccacccggtgaccgaggcgcgtatcgccgatacccgcaaccgtgccgagcaatttccccacggcggcatcgaggacagcctgcgctttcaactgatcaagaaacgcgtggagctgatttacgaagacacccccggcatggccgccaagcgcttccgtgccttgctggacgaaaacccgaaatcggaccccgcccgctacggcctggccattgcccagatcaaggccagccagttcaacgaggcctggggaaacctcaagccgctgctggccaaggcgcccaacgagatcatctacaacatggccgcggtcagcctggacatggccaacaacaagctcgccgatgcccagtcgcgggttgaccgcctgctggcgctgtaccctgacaattacccgctcaaccaggtgcgagtcgacctgctgatcaagcagaaccgcaccgccgacgccgagaaatccctggaagacctgctcaaatcgcgccccaatgacccggacgtgtggaaccaggtggccgatacccgtggcgccaacggcaacatcatcgggctgcaccaggcccgcgccgaatacttcgccctggaaggcgacttccgccaggcccagcagcagctggacttcgccaagcgccgcgcggccaacaacttccaactggcgtcgcgtatcgatgcacggcaaaaagacctggccgagcaggagcgcatggtcaaggaactgatgcgcggctga

SEQ ID NO: 2227 - DNA, 1311 bp, unknown
  environmental sample
atgaattttttgcgtcctacactgctcaccctcgcctgcctgttcgctacacacggcacggcggatgacctcccctcgcttggtgacgccagctcctcgattgtctcccccgaacaggagcactgtctgggccgtgcgtggctggggttgctgcgcggccaggtggcgcagctgtcggacccgcaactcaaggactacgtcgaaacttcggtctacagcctggccgagaccagtcaggttcaggaccggcggcttgaattcatcctgatcaacagcccgcaactcaacgcctttgccgcacccggcggcatcatcggcgtcaacggcggcctgtttctcaacgcgcagaccgagggcgagtacgcttcggtactggctcacgagctggctcacttgtcgcagcgccacttcgccagaggcatacaagcccagcaacgcatgcaggtgccagtcatggccgcgatgctggcaggtatcgtcatggcagccgcaggcgccggtgatgcgggtatcgccaccatcgccggctcacaggctgccgcgatccaggaacaacggcgcttttcgcgccagaacgagcaggaggctgaccgcatcggcattctcaacctggagaaggccggttatgacccgcgcaacatgccgaccatgttcgaacgcctcatgcgccaatatcgattcgacgccaggcctccggagtttttgctgactcacccggtcagcgagtcgcggatcgccgatacacgcaaccgtgccgagcaggccaaaccgggcggcaaggaagacagcctgctgtatcaactgatgcgcgcccgtgtggcactgatctatgaagaaaccccaggcatcgccgccaaacgcttccgtgcgcaactggttgaaaacccgaaatccgatccggcgcgctatggtctggccatcgcgcagatcaagggcggacaactgaacgaggccagggaaaccctcaagccactgctcgaaaaagcgccgaacgacattacctacaacctgacgcagatcgacctggacatcaccaataaccggctggccgatgcgcagcagcgtgtcgatcgcatgttgacgctgtaccccggcaattatccgctcaacgacgtgcgtatcgacgtgttgctcaagcagaaccgcaccgccgaagccgagaaaagccttgaagcgctgctcaagacccgcccggatgatccggacatctggtacgtcgtggcggaaacgcgtggcctgaacggcaacaccatcggcctgcatcaggcgcgcgccgaatactttgcgctggtcggtgatttccgtcaggcg

SEQ ID NO: 2228 - DNA, 1434 bp, Pseudomonas sp.
atgaatttcctgcgccctgcccttttgacgctcgcctgcctgtctgcctccgcccaggctgccaacgacttgccgtcactgggagacgccagctcggccattgtctcaccccagcaggagcatcagctaggtcgggcgtggctgagcctgctacggggtcaggtaagccaattatccgacccccagctcaaggacttcgtcgagaccagcgtctaccggctcagcgaaagcagccaattgaatgatcgacgccttgagttcgtgttgctcaacagcccgcagatcaacgcattcgccgcccccggcgggattatcggggtcaacggcggcttgttcctgtatgccgagactgaagcagaatatgcctcggtactggctcacgaactggctcacttgtcgcaacgtcactttgcccgcggcctggaagcccagcaacgcatgcaactgccggtaatggcggcgatgctggcaggaattgtcgctgcagcagcaggtgcaggtgacgctggtattgcggcgatcgcctcgacccaggcagcagccatccaggaacaacggcgcttttcccggcagaacgaagcagaggccgaccgtatcggtattatcaacctcgagaaggccggttacgacccaaaggccatgccgaccatgtttgagcacttgatgcgtcagtatcgctatgaccgcatgccgccggaatttttgctcacccacccggtgtccgaatcgcgtatcgccgacacccgcaaccgcgcagagcagttaccaagcggcggcaagaaagacagcctggaataccagctgatgcgcgctcgggtgcaactgttttatgaaggcacgcccggcctggcggcaaaacgctttcgcgccgagttgaacgaaaacccgaaaaacgacgctgcacgctacggcctggccatcgcgctgatcaagggcggaagacagaaagaggccggcgagattctggcccagctgctgagcaagtcgcccaagtcgattccctacaacctcgcccaggttgacctggataccgcagccagccgcttgagtgaggcccagagccgcctggagcgcatgctcagggattatccagacaattacccactgaaccaggcacgggtcgatctgatgatccgccaaggccgcacccaagacgccgagagcaagctagacgccctgctcaagtcgcgacccaaggatcctgacgtctggtatcaagttgcagaagtacgcggcctcagcggcaacagaatcggcctgcaccaggcgcgcgccgaatacttcgccctggttggcgactacaagcaggcaatcgagcagctcgactacgccaaacgccgcgcagccaacaacttccagctggcctcacggatcgacgcccgccaacgtgagctggccgaagagaagcgcatgatcgacgaaatgctcaattaa

SEQ ID NO: 2229 - DNA, 1434 bp, Pseudomonas sp.
atgacttttctgcgccctaccctgttgacgctcgcctgcctgttcgccggccagatcggagccagtgacctgccgtcgctgggcgacgccagttcctcgatcgtctcgccgcagcaggaacaccagctcggccgcgcctggctgggcctgctgcgcggccaggtggcccagctggacgacccgcagctcaaggacttcgtcgagaccagcgtctatcggctgtcggaaaccagccagctgcaggatcgccgcctggagttcgtgctgctcaacagcccacagctgaacgccttcgccgcgcccggcgggatcatcggggtcaacggcggcctgttcctctatgcgcagaccgaagccgaatacgcctcggtgatggcgcacgaactggcgcacctgtcgcagcgccacttcgcccgcggcgtcgaggcccagcaacgcatgcagctgccggtgatggcggccatgctcgccggcatagtcgcggcggcggccggtgccggtgatgccggcatggcggcgatcatgtcgacccaggcagcggcgattcaggagcagcgccgcttctcccggcagaacgaacaggaggccgaccgcatcggcctgctcaacctggaaaaggccggctacgacccgcgcgccatgccgctgatgttcgagcggctgatgcgccagtaccgctacgacgccaagccgccggaattcctgctcacccacccggtgtccgaatcgcgtatcgccgatacccgcaaccgcgccgagcagtacccggcccagggccgcgaagacagcctgcgctaccagctgatgcgcgcccgcgtgcagctgacctacgaggaaaccccgggggtagcggccaagcgttttcgcgccatgctcgacgagaaccccggcctcgacgccgcgcgctacggcctggcattggcgcagatgaaaaccggccagctcggcgaagccggacagaccctggcgcccctgttgagcaaggcgccggaggatatcgtctacaacctggcgcagatcgaactggacatggccgcgaaccgcctggacgccgcacagcggcgccaggagcgcatgttcgcgctgtatcccagcaactacccgctgcagcaggcgcatatcgacctgttgctcaagcagcagcgcacccgcgaggccgaacgggcgctggacgagttgctgaagaaccgcgccaaggatccggacgtctggtaccaggtcgccgaggtgcgcggcctgagcggcaacaccatcggcctgcaccaggcccgcgccgagttcttcgccctggtcggcgactacaaccaggccatcgaacagctcgacttcgccaagcgccgcgccagcaacaacttccagctggcctcgcgcctcgacgcccgtcagcgcgagctggccgaggaaaagcgcctggtggagcagatgctgcgctga

SEQ ID NO: 2230 - DNA, 1431 bp, Pseudomonas sp.
atgaatcttctgcgccccaccctgctcgccctggcctgcctcgcactgcccgcaggcgccagcgacctgccgtcgctgggcgacgccagttcatcgatcgtctcgccggaacaggaacaccgccttggccgcgcctggctcagcgtcctgcgcgggcagatcgatcagctgtccgatccgcagctcaaggactatgtggaaaccagcgtctatcgcctggccgagaccagccagctggaagaccgccgcttggaattcgtcctgctcaacagcccgcagatcaacgccttcgccgcccccggcggcatcgtcggagtcaacggcggcctgctgctgcacgcccagaccgagggcgaatacgcctcggtgatggctcacgaactggcgcacctgtcgcaacgccacttcgcccgcggtgtcgaggcccagcaacgcatgcaggtaccggtgatggccgccatgctcgccggcatcgttgctgccgctgccggcgccggagacgccggtatcgccaccatcatgggtgcgcaggccgccgccatccaggagcagcgccgcttctcccgacagaacgaacaggaagccgaccgcatcggcctgctcaacctggagaaagccggctacgatccgcgcgccatgcccagcatgttcgagcgcctgatgcgccagtatcgctacgactccaagccgccggaattcctcctcacccacccggtcaccgagtcgcgcatcgccgacacccgcaaccgcgccgagcagtacccctcccagggcatctccgacagcctcggctaccagctgatgcgggcgcgcacccagctgatgttcgaggaaacccccggcatcgccgccaagcgcttccgcgccatgctcgacagcaaccccaggctggaagcggctcactacggcctggccatcgcccacatcaagggcggccgcctcgccgaggcgcgcagcgagctgaacgccctgttgaccaagaagcccaacgatctcacctacaacctggccatgatcgaactggacagcgcggccaaccgactgagcgacgcccagcagcgtatcgagcgggtgcgcagcctgtatcctgatagctacccgctggagcaggcgcgcatcgacctgctgctcaagcagaaccagaccaaggaagccgaagtcgccctcgaccagctgctcaagcaacgcagcaacgatccggacgtgtggtatcaggttgcagaggtgcgcggcctgacgcgcaacatcatcggcctgcaccaggcccgcgccgagttcttcgccctggttggcgactacgaccaggcactggagcagctcgacctggccaagcgccgcgccagcagcaacttccccctggcctcgcgcatcgacgcccgccagcaggagctgatggaagagaaacgcgcgctggacaagatgatgcgctga

SEQ ID NO: 2231 - DNA, 1626 bp, Pseudomonas sp.
ttgcatccagttcggcgtcgcacacctcggggcgcactacagcgtcagacatcgtttctctccaggcggacacatcgaattacaaaccatgtccgaaaaggcatggcggataaggcggcaagaatacctcactctggtcagcacgccattgagccagctacagtacaggttcttctgaccagagcttcgtgcatgaattttttgcgtcctacactgctcaccctcgcttgcctgttcgctacgcatggcatggctgatgacctgccttcacttggcgacgccagctcctcgattgtctctcccgaacaggagcaccgtctgggccgtgcgtggctggggttgctgcgcggccaggtggcgcagctgtcggacccgcaactcaaggactacgtcgagacctcggtgtaccgcctggccgagaccagccaggttcaggaccggcgtcttgaatttatcctgatcaacagcccgcaactcaacgcctttgccgcacccggcgggatcatcggtgtcaacggcggcctgttcctcaacgcccagaccgagggcgaatacgcgtcggtactggcccacgagctggctcacttgtcgcaacgccacttcgccagaggcatggaggcccagcaacgcatgcaggtgccggtaatggccgcgatgctggcgggtattgtcatggctgccgcaggtgccggtgatgccggtatcgcaaccatcgccggctcacaggcggctgcaatccaggagcaacgtcgcttttcgcgccagaacgagcaggaggccgaccgtatcggcattctcaatctggagaaggccggttatgacccacgcaacatgccgaccatgttcgagcgtttaatgcgtcagtatcggtttgatgcaaggccaccggagtttctgctgactcacccggtgagcgaatcgcggatcgccgacacacgcaaccgcgccgagcaggccaagcctggcggcaaggaagacagtctgctgtatcaactgatgcgtgcccgcgttgcgttgatatacgaagaaacaccaggtatcgccgccaagcgttttcgtgcgcaactggttgaaaacccgaaatccgatccggctcgctatggcctggccatcgcgcagatcaagggttggcaactgaacgaagccagagaaaccctcaagccattactcgaaaaaacgccaaacgacatcacctacaatctgacgcagatcgacctggacatcaccaataaccgcttggccgatgcccagcaacgggtcgatcgcatgctgacgctgtaccccggcagctacccgctcaatgacgtgcgcattgacgtgctgctcaagcagaaccgcaccgccgaagctgaaaaaagccttgaagcgctgctcaagacccgcccggatgatcccgacatctggtacgtcgtggcggaaacccgtggcctgaacggcaacaccatcggcctgcatcaggcgcgcgccgaatatttcgcactggtcggcgatttccgtcaggcaatccagcaactggactttgccaaacgccgtgcggccaacaacttccagttggcgtcacgcatcgatgcacggcaaaaggatctgattgaacaagagcggatggtcaaggacatgatgaactga

SEQ ID NO: 2232 - DNA, 1431 bp, Pseudomonas sp.
atgaaattgctgcgccccgccctgctcacgctcgcctgcctgactgcactgccagcattggccaacgacctgccttcgctcggcgatgccagctcctccatcgtttcacctgaacaggagcaccagctcggccgggcatggctcagcctgctgcgcgggcaggtaagccagctctcggacccacagctcaaggactatgtagaaagcagtgtctatcgcctggcagaaaccagtcagctgcaggatcgtcgccttgaattcgtcctgctggacagcccgcagctgaatgccttcgcagctccaggcgggatcattggtgtcaacggtggcctgttcatctatgcccagaccgaagccgaatatgcctcggtgatggctcacgaactggcgcacctttcccagcgccatttcgcccgcggactggaagcgcaacagcgcatgcaactgcctctgatggccgccatgctggccggcgtcgtcgcagccgcagccggcgcaggtgatgccggcatcgccgccatcgtgtctacccaggccgctgccatccaggcccagcgccgcttttcccggcagaacgaacaggaggccgaccgcatcggcatcgtcaacctcgagcgggccggttacgacccgcgtgcgatgccctcaatgttcggtcgcctcatgcgccagtatcgttacgatcagaagccaccggaattcctgctgacacacccggtcagtgaatcacgcatcgcggataccacaaaccgagcggaacagtatccacagggtggagcacaggacagcctgcgctaccagctgatgcgcgctcgaacgcaattgaagttcgaaagaacaccgggcgtcgaggccaagcgattccgcgcgatgctcagcgaaaatccagagatggatgccgcacgctatggccttgcgctcgcgcaagtcaaagctgggcaactcgacgaagcgaacagcagccttgccccgctgctagccaaggcaccggacgacatcacctacaacctcgcgcagatcgaactcgatatcaccgccaaccgcctgcaacaggcgcagacccgtttacagcggttgctgcagctatatccgggcaactacccggtgcgccagatgcacattgaccttctgatggagaagggcgagacacagcaagccgagcgcgagctggacaagctggtggagcagcgccgccaggatcccgatatctggtatcaggtcgccgaagtgcgcgggctcagcggcaacatcgttggcctgcatcaagcacgcgcggagtacttcgccctggtaggcgactatgaccagggcatcgagcaactcgacctcgccaagcgtcgtgccagcaacttccagatcgcatcacggatcgacgcgcgccagaaacagctgatcgaagaaaagcgaatggtcgaggaaatgctgcgctga

SEQ ID NO: 2233 - DNA, 1437 bp, Pseudomonas sp.
atgaaagtactccgccctgccctgctgtcgctcgctgtcgccttcgccatgccggccctggcggacgacctgccttccctgggggacgccagctcgtccatcgtctccccggagcaggagttccagctcggccgcgcctggctgagcatgctgcgcaaccaggtcgacacgctcaacgatccgcaactcaaggactatgtcgagtccagcgtctaccgcctggcggagtccagcgaactgcaggaccaccgcctggcgttcatcctgatccgagacaaacagatcaacgccttcgccgcccctggcggcgtggtcggcgtcaacggcggcctgttcatctatgcccagaccgaaggcgagtacatcgcagtactggcgcacgaactcggccacctcagccaacgccacttcgcccgcggcatcgaagcacaacagcgcatgcaggtaccggtgatggccgccatgctggccggcatcatcgccgccgccgccggcgctggtgatgcgggtatcgctgccatcgccggcacccaggccgcggccatccagaaccaactgcgcttctcccggcagaacgaacaggaagccgaccgcgtcggcgttgccaccatggtccgcgccggctacgacccgcgctccatgcccaacatgttcgagcgcctggcccgccagtaccgttacgagggcaaaccgccggaattcctgctgactcacccggtcaccgaatcgcgtatcgccgacacccgcaaccgcgccgagcagtaccccaagggcggcaaggaagactcgctgcgctacgagctgatgcgcgcccgcgtccagcagatgttcgaagacacgccgggcatggccagcaagcagttccgcgcgcaactcgacgaagacccgaagaacgacgctgcgcgctacggccttgcgctgtcgcagaccaagatcggccagctcaacgacgcccgcagcaacctgcagcagctgctggccaaggcgcccaacgacatcagctacaacctggccatgtccgatctcgacatcaccgccaacaagctgcccgacgcccaggcgcgggtgcagaagatgctcggccagtacccggacagctacccgctgatccaggccaatgccgacctgatgatgaagaccaaccgcgcggccgatgccgagaaaacgctgttcaagctgtcccagcgccgcccgctggacccggacgtgtggaaccgcctggccgacgcctgcaccctgagtggcaacgccattggcgtgtaccaggcccgcgcggagtactacgcactcaccggcgactacaagcaggcgatcgagcagctggacttcgccaagcgccgcgccggcggcaacttcaccctggccgcgcgcctggatgcccgccagcaggagttccgcgagcaggagcgcatcctcaaggaaatgatgggacgctga

SEQ ID NO: 2234 - DNA, 1443 bp, Pseudomonas sp.
atgtacatgaaagtactgcgccctgccctgctgtcgcttgcctgcctgctggccatgcccaccgtggcggacgacctgccgtccctgggcgattccagctcgtccatcgtttcccaggagcaggagttccagctcggtcgcgcctggctgagcatgctgcgcaaccaggtcgactcgatcaacgacccgcagatcaaggatttcgtcgaatccagcgtctatcgcctggccgaaaccagcgacctgcaggaccaccgcctggctttcatcctcatcaaggacccgcagatcaacgccttcgccgcacccggcggagtcatcggggtgaacggcggcctgttcctctatgcgcaaaccgaaggcgagtacgccgcggtactggcgcacgaactgggtcacctgatccagcgccacttcgcccgcggcctggaagcgcagaaacagatgcagttgccggtaatggcagcgatgctcgccggtatcgtcgcggccgccgccggcgccggcgatgccggcatcgccaccatcgcctcgacccaggcggcggcgatccagaaccagctgcgcttctcccggcagaacgagcaggaggccgaccgcgttggcgtggtcaacatggttcgcgccggctacgatccgcgctccatgccgaccatgttcgagcgcctggcgcggcagtaccgctacgacgccaagccgccggaattcctcctcacccacccggtcaccgactcgcgtatcgccgacacccgaaatcgtgccgagcaatacccgtcgagcggcaaggaagacagcctgcgctaccagttgatgcgcgcccgcgtgcagctgatcttcgaggaaatgcccggcatggccggcaagcgcttccgcgccatgctcgacgacaatcccaagctcgatgccgcgcgctacggcctggcgctgtcgcagacccgcatcggccagctcaacgaagctcgcgccaccctgcaaccgctgctggccaaggcgcccaatgaactggcctacaacctcgcccaggtcgacctggacatcaccgcgaacaagctgaacgacgccctctcccgcgtgcagcgcctgctgggccagtaccccgacagctacccgctgatccaggcccagaccgacgtgctgatgaagctcaaccgcgcggccgacgccgagaagatcctgatcaagctgacccaggcccgcccgctcgacccggacgtctggagccgcctggccgacgcccgcaccatcgacggcaacgccatcggcgtgcaccaggcgcgcgccgagtacctggcgctgaccggcgactacccttcggccatcgagcagctggacttcgccaagcgccgcgccggcggcaacttcaccctggccgccaagctggatgctcgccagcaggaattccgcgaccaggagaagatcctcaaggaaatgatgcgcggctaa

SEQ ID NO: 2235 - DNA, 1740 bp, Pseudomonas sp.
atgaatttttctctcaagcacctggccgcgaccaccctggtactggccggcctttcgtcgctcaccacgctcgcgcacgccaacatcagcccgcaacagagcgcgactatcctcaagaccttcagcgacgcatcggtaacggatttcaggcaattcctgggaggcgtggtcaagagtgacctggccaaaaccgccaacctcggcccggccatcagtgcctttctcgacaacaaaaccctgtctgccgaacagcagaacgagatcaatcgcctgctgggtatttatgcccgggtgaaatatggcagcgcggccaccgagaccctgcgtgaactggtggaaataccgaccttccaagtggacggtgtagcccagcacgacaaccctgaattcatcaagatcgccgacaagatcaagggcctggcccaggccttcaacctgaactttcgcaacatcgataaccgcgtctacgaaatctccctggaaggcagtggcgatgaagtcgtgggcatccacgcccatgccgatgtggtgcccgtgacgccggagaactgggtcctgaaggacggcaccaaactcgatccgttcaaggtcactctgatcggcgaccgcatgtatggccggggcaccgaggatgataaaaacggcatcgtggtggcgatgtacgccatgaagatcatcaaggaagagaagctgccgctggccaggaacttcaagctgttagtcgacaccaccgaagaaaccaccggcgacgcgatcccttattacttcgaacacaacccgacacccaactacaacctggcgctggatggcggctatccggtggtgattgccgagaaaggctacggcacagtcatggccaacttcccgcgacgtaatggtcaaggcaagggcgccgaaatcatctcgatgacaggcgggatggccaccaaccagattccttctgcttcggtggccacccttgtcaccgacaagcccgccgaactggccgccagcctgcagaaagccggttcggattatgccaagcgcaatggcggtaacttcgaggtaaacgccaaggtcgacggcaaggacgtcaagctgaccgtcaccggcgtttccgctcactcctccgagcccgagtccggtgttaacccagtggccaggatgctgggcttcatccatagcgttgatggaaaagtcgcgctgaagcacaaccacatcactgacgctgcccgctacgccgccgacaactggggcctggattacctgggtggcaaattgggggtcggcttctccgatgccttcatgggtccgctgaccacttccctgacttttgtcgggatggatgacaaagccttcaagctcgcggtcaacctgcgcgtgccgaagggcgagtccccggaagcgctcaaggcgaaaattgctgaaaagattggcgcctggagcaagaagtcccacgtagcggcgaccttcacctactcgatcgccgagccgatgtaccgcaaccctgagggtgaatgggtcaaggccttgctggcggtgtccactgaaaacctggatatggaacacaagttcggcagctccgccggcgcaacgtcggttcatgagctgcccaatggagtgcaattcggcctggccaggcccgaggtcaagtacaccggccacaccgacaacgagttcaagaccgtcgaccagttcctgctggacctgcagatcgtgaccgagatgatggggcgcatcgggcagttgccgaagctctga

SEQ ID NO: 2236 - DNA, 1740 bp, Pseudomonas sp.
atggacttctcacttaagcatctggccgcgtcgaccctgattctggccagcctttcgtcgtttaccgtagccgcgcaaaccaacatcaccccgcaacagagtgcgaccattctcaagaatttcagcgacgcctcagcctcggatttcaggcagttcctggccggcgtggccaaaagcaacctggccaaaaccgccgacctcggcccggccatcagcgctttccaggacaacaagacgcttaccccggaacagcagaacgaaatccatcgtcttctgggcctctatgcacgggtgaaatatggcgctgcggctaccgagacgttgcgtgagctggtggcaatcccgaccttccaggtggagggcgttgctcagcacgacaaccccgaattcatcaagatcgccgacaagatcaaaagccttgcccagtccttcaacctgaatttccgcaacatcgacaaccgtgtctatgaaatttcccttgagggcagcggtgatgaagtggtgggcattcacgcacatgccgacgtggtgccggtgacgccagagaactgggtcctgaaagacggcacccgcctggatccgttcaaggtcaccctgatcggcgaccgcatgtatggtcgcggtaccgaggatgacaagaacggtatcgtggtggccctgtacgccatgaaggtgatcaaggaagagaagctgccgctggcaaggaatttcaagctgctgatcgacaccaccgaagaaaccaccggcgacgccatcccctattacttcgaacacaacccgacgcccaactacaacctggcgctggacggcggctacccggtggtcatcgccgaaaaaggctacggcaccgtgatgggcagctttgcccggcgtgacggcgagggccagggcgcggaaatcacctcgatgaccggcggcttggccaccaaccagattccgtcggcttcggtcgccacattagtgactgacaagcctgccgaactggccgccagcctgcaaaaggccggtagcgagtatgccaagcgcaatggtggaaacttcgaggtaagcgccaaagtcgtcgacaaggacgtcaagctcacggtgaccggcgtttccgcccactcctccgagcccgagtctggcgtcaacccggtcgccaggatgctggacttcatcaacagcctcgacggaaaagtcgcgctcaagcacaaccacatcaccgacgccgcccgctacgctgccgacaactgggggctggattacctgggcgggaaattgggtgtcggttttgccgatgacttcatggggccgctgacgacgtctctgacctttgtcgggatgaatgacacaaccttcaagctggcggtcaacctgcgcgtgccgaagggcaagtccccggaagccctcaaggccgaaattgccgaaaagattggcgcttggagcaagaagagccacgtagcggcaacgttcgactattccatcgccgagccgatgtatcgcaatcctgagggtgagtgggtcaaggccttgctggccgtggccagcgaaaacctgggcatggaacacaagtacggcacttctgccggcgccacgtcggtgcatgaactgcccaatggtgtgcaattcggcctggcccggccggaagtgaaatacaccggccacacggataacgagttcaagacggtcgaccagttcctgctggacctgcagatcgtgaccgaaatgatggggcgcatcgggcagttgccgaagctctga

SEQ ID NO: 2237 - DNA, 1740 bp, Pseudomonas sp.
atggacttctcactcaagcacctggccgcaacaaccctgatgttggccagcctttcatcgttcaccacggccgcgcacgccaacatcaccccggaacagagcgcgaccatcctcaagacgttcagtgacgcatcggccaccgatttcaggcagttcctgacaggcctggccaagaccgacctggccaaaaccgatggcctgggcgcagcaatcagcgccttcctggacaacaagtccctttctgccgaccagcagaacgaaattcatcgcctgctggggctctatgcgcgggtgaagtacggcagcgccgccaccgagacgctgcgtgagctggtggccatcccgaccttcaacgtcgacggcgttgcccagcacgacaaccctgaattcatcaagatcgccgacaagatcaagagccttgcccaggccttcaaccttaacttccgcaacatcgacaaccgcgtctatgagatctccctcgatggcaccggcgatgaagtggtcggcattcacgcccacgccgacgtggtgcccgtgacaccggagaactgggttctggaagacgggaccaaactcgatccgttcaaggtcaccctgatcggcgaccgcatgtatggccggggcaccgaggatgacaagaacggcatcgtggtagcgctctacgccatgaaagtgatcaaggaagagaagctgccgctggcgaggaatttcaagctgttggtcgacaccaccgaggaaacctccggcgacgccatcccgtactacttcgaacacaacccgacacccaactacaacctggcgctcgatggcggctacccggtggtgattgccgaaaaaggctacggcaccgtcatggccaatttccccaagcgcaaggcggacggcaaaggcgctgaaatcgtctcgatgactggcggcctggccactaaccagatcccgtcggcttcggtcgtcacgctgctgagtgacaagcctgccgaattggccaaaagcctgcagaaggccggtgctgagtttgccaagcgcaatggcggcaatttcagcgtgaacgccaaggttgacggcaaggacgtcaagctgacggtcaccggcgtttccgcccactcctccgagccggagtcaggcgtcaacccggtttccaggatgctggtctttatcaatggcctcgacggcaaggtcgcgctcaagcacaaccacatcaccgacgccgcccgctacgccgctgacaactggggcctggattacctcggaggcaaactgggagtcggtttctccgatgccttcatgggcccgctgaccacgtccctgacgtttgtcgggatggatgaaaaagccttcaagcttgcggtcaacctgcgcgtgccaaagggcaagtccccggaagcgctcaaggccgaaatcgccgacaaaattggcgcctggagcaagaagtcccgcgttgcagcgactttcgattattcgattgccgagccgatgtaccgcaaccctgagggtgaatgggtaaaggccctactggccgtggccagcgaaaaccttggcatgaaacacgagtacggcacctccgccggcgccacctcggttcatgaattgcccaatggcgtgcagttcggcctggcccggcccgaggtcaaatacaccggccacaccgacaacgagttcaagaccgtcgaccagttcctgctggacctgcagatcgtgaccgaaatgatggggcgcatcgggcaattgccgaaactctga

SEQ ID NO: 2238 - DNA, 1740 bp, Pseudomonas sp.
atggacttctcactcaagcacctggccgcgacaacgttgatgctggccagtctttcgtcgttcaccacagcagcgcacgccaacattaccccgcagcaaggcgcggccattctcaagacgttcagtgacgcatcgatcacggatttcaggcagttcctgacaagcgtggccaagagcgatctggccaaaaccgacgacctcggcacggcaatctctgccttcctcgacaacaagagcctttccgccgaccagcagaacgaaatccatcgcctgctcggcctctatgcgcgggtgaaatacggcagcgccgccaccgagacgctgcgtgaactggtggccatcccgaccttccgcgtggacggcgttgcccagcacgacaaccctgaattcatcaagatcgccgacaagatcaagagcctggcccaggccttcaacctgacctttcgcaacgtcgacaaccgcgtctatgaaatctccctcgaggggagcggcgatgaagtggtgggcattcatgcccacgccgacgtggtgcccgtgacaccggaaaactgggtcctgaaagacggcacccgcctcgatccattcaaggtcaccctgattggcgatcgcatgtatggccgtggtaccgaagatgacaaaaacggcatcgtggtggcgctctacgccatgaaagtcatcaaggaagaaaagctgccgctggcgaggaatttcaaactgctggtggacaccaccgaggaaaccagcggcgacgccatcccttattacttcgaacacaaccccacacccaactacaacctggcgctggatggcggttacccggtggtgatcgccgagaaaggctacggcaccgtcatggccaacttccccaagcgcaaggctgacggcaagggtgctgaaatcgtctcgatgactggcggcctggccaccaaccagattccgtcggcgtcggtcgccaccctgctgagtgacaaacccgccgagctggccgccagcctgcaaaaggccggtaccgaatacgccaagcgcaatggcgacgatttcgaggtgacggccaaggtcgtcggcaaagacgtcacgctgacagtcaccggcgtttccgcccactcctccgagcccgagtccggaatcaacccggtggcgagaatgctggtgttcatcaacagcctcgacggcaaggtcgccctcaagcacaaccacatcaccgacgcggcccgctacgctgccgacaactgggggctcgattatttgggtggcaaattggcggtcggtttttccgatgcgttcatggggccgttgaccacctccctgacctttgtcgggatggatgaaaacaccttcaaactcgcggtcaacctgcgcgtaccgaagggcaagtccccggaaatgctcaagcgcgaaatcgccgacaagctggacgcctggagcaagaaatcccaggttgcggtggccttcgattactcgatcgccgaaccgatgtaccgcaatcccgagggtgaatgggtcaaggcgcttctcgccgtggccagcgaaaacctgggcatggaacacaaattcggcacctcggccggcgccacttcggtccatgaactgcccaacggcgtgcagttcggcctggcccggcccgaagtcaaatacaccggccacaccgacaacgagttcaagaccgtcgaccagttcctgctggacttgcagatcgtgaccgagatgttcgggcgcatcggccagttgccaaaactctaa

SEQ ID NO: 2239 - DNA, 1740 bp, Pseudomonas sp.
atggatttctcactcaagcacctggctgcgacaaccctgatgctggccagcctttcgtcgttcaccacgtcagcgcacgccaacatcaccccgcaacagagcgcgaccatcctcaagactttcagtgacacatcggtcaccgatttcaggcaattcctgggacgcctggccaagagcgaccttgcccacgctagtgatctcggcccggcaatcagtgccttccagggcaacaagccgcttaccgctgaacaacagaacgagattcatcgcctacttggcctctatgcacgggtgaaatacggcaacgcggccaccgagaccctgcgcgagctggtggcaatcccgaccttccgggtggacggcgttgctcagcacgacaatcccgaattcatcaagatcgccgacaagctcaagggcctcgcccaagcgttcaacctgaattttcgcaacatcgacaaccgcgtctatgaaatctccctcgcaggcgatggcgacgaagtcgtaggcattcacgcacatgccgatgtggtgcccgtaacgccggagaactgggtcctgaaagacggcacccgactcgatccgttcaaggtcactctggtcggtgaccgcctgtatggccggggcaccgaggatgacaagaacggtatcgtggtggcgctctatgccatgaagatcatcaaggaagagaagctgccgctggcgagaaatttcaagctgctggtagacaccaccgaagaaaccaccggcgacgccatcccctattacttcgaacacaacccgacgcccaactacaacctggcgctggatggcggctacccggtggtgattgccgagaaaggctacggcaccgtcatggccagttttcctcggcgcgccgcagagggcaaaggcgccgaaatcactgcaatgacggggggcctggcaaccaaccagattccatcgacgtcggtcgccaccctggtaaccgccaagcccgccgaattggccgccagcctgcagaaggcaggtggcgattatgccaagcgcaatggcggcaacttcgaggtgagcgccaaggtcgtcggcaaggacgtcaagcttgtggtcaccggcgtttccgcccactcctccgagcccgaatcaggcatcaatccggtggcaaggatgctggacttcatcaacagtctcgacgggaaggtcgcgctcaagcacaaccacatgaccgacgccgcccgctacgccgccgacaactgggggctggactacctgggtggcaaattgggggtgggcttttccgatgacttcatgggaccgctgaccgcatccctgacctacgtcgggatggatgaaaaagccttcaatctcgcggtcaacctgcgggtgcccaagggcaaatccccggaagtgctcaaggccgaaatcgccgacaagcttggcacctggagcaagaagacccacattgcggcggcctttgactactcgatcgccgagccgatgcaccgcaaccctgagggtgaatgggtcaaggccctgctggccgtggccagagaaaacctcggcatggaacacaagttcggcacctctgccggcgccacttcggtccatgagttacccaatggcgtgcaattcggcctggccaggcccgaggtcaagtacaccggccacaacgacaacgagttcaagactgtcgaccagttcctgctggacctgcagatcgtgaccgaaatgttcgggcgcatcggacagatgccgaaactctga

SEQ ID NO: 2240 - DNA, 1740 bp, Pseudomonas sp.
atgcactctccactcaagcaactggccgctgccaccctgttcgcggcgagcctttcggccatctccagccccgctttcgccaacatcaccccagaccaaagcacagcgattctgaagaatttcaacgaaacgtccgtcaccgatttccgtggtttcctcggcgccctggccaagggcgacctgggcaagaccagcgatgtcggcccggcgatcagtgcgtttcttgataacaaaaccttgagcgcggatcagcagaacgagatcaatcgcctgctcggcatctacacccgagtgaagtacggcaaggccgccaccgaaaccctgcgcgagctggtggaaatcccgacctttaacgtggacggtgtgccgcagtacaagaacccggaattcatcaagatcgccggcaagatccaggacctggccaaggcctttaacctgaacttccgcaacatcgacaaccgtgtatacgaaatctccctggaaggcagcggagatgaagtggtcggcatccacgcccacgccgacgtggtgccggtgacgccggaaaactgggtgctgaaagatggcaccaagctcgatccgttcaaggtcacgctgatcggcgaccgcatgtacggccgtggcaccgaggatgacaagaacggcatcgtagtggccatgtacgccatgaaggtgatcaaggaagagaagctgccgctggcgcgcaacttcaagctgctggtagacaccaccgaagaaacctccggcgacgcgatcccctactacttcgaaaagaatccgacaccgcagtacaacctggcactggatggcggctacccggtggtcattgccgagaaaggctacggcacggtgatggcgacgttcccgcgtcgcaagggtgaaggcaaaggcgcgcaaatcatctcgatgaccggcggcatggcgaccaaccagattccatcggcgtcggtggcgacgtttgtcaccgacaagcctgccgaattggccgccaacctgcaaaaggccggcactgaatacgccaagcgcaacgggggcgattttgaagtggccgccaaggtcgacggcaaggacgtcaaactgaccgtcaccggcgtgtccgctcactcgtccgagccggagtccggggtcaacccggtatcgcgcatgctggagctgatccacagcgtcgacggcaagatcgccctcaagcacaaccacatcaccgatgcggcacgttatgcgtccgacaactggggcctggattacctgggcggcaagttgggcgtgggcttctccgatgagttcatggggccgctgaccacctcgctgacgtttgtcggcctggatgacaaagccttcaagctggcggtgaacctgcgcgtgccgaagggcaagtcgccggagaaactcaaggccgagatcgccgacaagctgagcgcctgggacaagcaatccaaggtcaaggtggacttcacctactcggtcgcggagccgatgtaccgcaaccctgaaggcgaatgggtcaaggccctgctcgcggtgtccacggaaaacctgggcatggagcacaagttcggcacctcggccggcgcgacctccgtacatgaactgcccaacggcgtgcaattcggcctggcgcgtccggaagtgaagtacaccgggcacaccgacaacgagttcaagaccgtcgaccagttcctgctggacctgcagatcgtcactgaaatgatgggccgtatcggccagctgccgaagctctga

SEQ ID NO: 2241 - DNA, 1740 bp, Pseudomonas sp.
atggatttctccctcaagcaactggccgccgctaccctgatgctggccagcctcgcgtcattcaccagcgccgctcaagccaacatcacgccacagcaaagcgcggtcatcctgaaatccttcgacgacaaaaccgtcacggatttccgcgagtttctgggcagtctggccaagagcgacatcgccaaaagcgaaaatctcggcccggccatcagcgccttcctcgacaacaagaccctgaccgctgaacaactgaacgaagttcaccgtctgctgggtatctacacccgcgtgaaatacggcaaagctgcgctggaaaccctgcgtgaactggtcgagatcccgacctttcagaaggaaggtgtggcccagcacgacaaccctgagttcatcaagattgccgcgaagatccagagcctggccgaatcgttcaatctgaaattccgcaacgtcgacaaccgcgtttacgaaatttccctcgacggcgcaggcaatgaagttgtcggcattcacgcccacgccgacgtggtgccggtgacgccggaaaactgggtgctcaaggacggcaccaagcttgatcctttcaaagtcaccctgattggcgaccgcatgtacggacgcggcaccgaggatgacaagaacggcatcgttgtcgcgttgtacgcgatgaaagtgatcaaggaagaaaagctgccactggcacgcaacttcaaactgctggtcgacaccaccgaagagaccactggcgacgccatcccttactacttcgaaaacaacccgacgccggcctacaacatggcgctggacggtggttacccggtggtgattgccgaaaaaggctacggcaccgtgatggccaaatttgccaaacgcacagccgaaggcaaaggcgcggaaatcacctcgatgaccggcggcctggcgaccaaccagattccttcggcgtccgtcgtcacattgctgaccgacaaacctgccgaactggccgccagcctgcaaaaggccggcaacgagttcgccaagcacaatggcggcaacttcgaagtggcggccaaggttgacggtaaagacgtcaagctgacggtgaccggcgtttctgcgcactcctccgaaccggagtccggcgtgaacccggtggcgcgcatgctggtgttcatcaatagcctgaacggtaaagttgccctcaagcacaaccagttcaccgatgccgcccgctacgccgccgacaactggggcctggattacttgggcaacactttgaaggtgggcttctccgacagtttcatgggtccgttgaccacctctctgacgtatgtcggtgaggatgacaaagccttcaaactggcggtgaacctgcgcgtgccgaagggcaagtcgccagaaaaactcaaggctgaaatcgctgacaaactcagtgcctggacgaagaaaactcacgtcgcagtggccttcgattactcggttgccgaaccgatgtaccgtaatccggaaggtgagtgggtcaaggcgttgctggccgtatctacagaaaacctcggcatgaagcacgagttcggcacctctgccggtgccacgtcggtgcatgaactgcctaacggcgtgcaattcggcctggcacgccctgaggtgaaatacaccggacacaccgatggcgaattcaagaccgttgaccagttcttgctggacctgcaaatcgtcaccgaaatgatgggccgcatcgggcaactgccgaagctgtga

SEQ ID NO: 2242 - DNA, 1740 bp, Erwinia sp.
atggatttttccctcaagcaactggccgcggccacactgatgctggccagcctgtcagccttcaccacgaccgcctacgccaacatcaccccgcagcagaacgcggcgattctcaagagcttcgccgatgcatcggtcaaggacttccgccagttcctcggcaccctgggcaagagcgagctggccaagagcgccaacctcggcccggcgatcaatgccttcctcgacaacaagacactttccgccgagcagcagaacgagatccatcgcctgctgggcctctatgcccgggtgaagtacggcaaggccgccaccgaaaccctgcgcgagctggtggccatccccaccgtgcgcgtcgacggcgtgccccagcacgagaaccctgagttcctcaagatcgccgacaagatccaggccctggccaaggccttcgacctgaactttcgcaacatcgacaaccgcgtctacgagatctccctggaaggcagcggcaaagaagtggtgggcatccacgcccatgccgacgtggtgccggtaacgccggagaactgggtgctgcaggacggcaccaagctcgacccgttcaaggtcaccctggtcggcgaccgcatgtatggccgcggcaccgaggacgacaagaacggcatagtcgtggccctgtacgcgatgaagatcatcaaggaagagaagctgccgctggcgcgcaacttcaagctgctggtggacaccaccgaggaaaccagcggcgacgctatcccctactacttcgaacgcaacccgacgcccaactacaacctggcgctggacggcggctacccggtggtgatcgccgagaaaggctacggcaccgtcatggccagcttcccgcggcgtaccgccgagggcaaaggcgcggaaatcgtgtcgatgaccggcggcctggccaccaaccagattccgggcgcctcggtcgccaccctggtgaccgaccagcccgccgaactggccgccagcctgcagaaagccggcagcgaatacgccaaggcccatggcggcgacttcagcgtggccgccaaggtcgcaggcaaggacgtcaagctgacagtcaccggcgtgtccgcccactcctccgagcccgagtccggggtcaacccggtggcgcgcatgctcgacttcatcaacagcctcgatggcaaggtcgcgctcaagcacaacccgatcaccgacgcggcccgctacgccgccgacaactggggcctggactacctgggcaacaagctcggggtcggtttcgccgatgacttcatgggcccgctgaccacctccctgacctatgtcggccaggatgaacaggccttcaagctggcggtcaacctgcgcgtgcccaagggcaagacccccgaagtgctgcaacagcagatcgccgacaagctcgccgcctggagcaagaagaaccaggtcgcggtgaacttcgactacaagatcgccgagccgatgtaccgcaaccccgagggtgaatgggtcaaggcgctgttggcggtggccagtgaaaacctgggcatgcagcaccagttcggcacttccgccggcgccacctcggtgcatgaactgcccaacggcgtgcaattcggcctggcccgtcccgaggtcaagtacaccggccacaacgacaacgagttcaagaccgtcgagcagttccagctggacctgcagatcgtcactgaaatgttcggtcgcatcggccagctgccaacactctga

SEQ ID NO: 2243 - DNA, 1740 bp, Pseudomonas sp.
atggtcttttccctgaaaaaactggccgctgccacgctcgtcatggccagcctcacagcgtttaccagcgccgcacaagccaacatcactgccgagcaaagcgcggcgatcctgaaatccttcgacggcaagaacctgacggacttccgcagcttccttggcagcctggcgcaaagcgacctggccaagacggataagctcaacccctccatcagcgccttcctcgacaacaagaccctgaacgccgaacagcagaacgaaattcaccgcctgctcggcatttacacccgagtgaaatacggcaaggccgcgctggaaaccctgcgccaactcgttgaaattccgaccttccgcaaggatggcgtggagcaacacgacaacccggaattcatcaagatcgccggtgagattcagaaactcgctgaatccttcgggttgaaattccgcaacatcgataaccgtgtctacgaaatttctctggacggtaaaggcgacgaagtcgtcggcattcatgcccacgccgatgtggtgccagtgactccggaaaattgggtgctgaaggacggcaccaaactcgacccgttcaaagtctcgctgattggcgatcgcatgtacggtcgcggcaccgaggatgacaagaacgctatcgtcgtggcgctgtacgccatgaaagtgatcaaggacgagaaactgccactggcgcgtaacttcaagttgctggtcgacaccactgaagaaaccagcggcgatgccattccttattacttcgaacgcaacccgacgccaacctacaacatggcgctggacggcggttatccggtggtgatcgccgaaaaaggttacggcactgtcatggccaactttgccaagcgcaaaggtgaaggcaacggtgcggaaatcatttcgatgaccggcggcaaagcgaccaaccagattccatcggcttcggtggtcacgctggtaaccgacaagccaggcgagctcgccgccagcctgcaaaaggccggcgacgcttatgccaaggccaacggcggcgatttcgaagtcgcggcaaaggttgatggcaaagacgtcaaactgaccgtgacgggggtttctgcgcactcctccgagcctgagtccggcgtcaacccggtcgcacggatgctgagcttcatcaacagcctggacggcaaagtcacgctcaagcacaaccagttcaccgacgccgcacgttatgccgatgacaactggggcctggattatctgggcaaaaaacttggcgtgggcttctccgactcgttcatggggccactgaccacctcgctgacctacgtcggtgaggatgacaaaaccttcaagctggcggtgaacctgcgcgtaccgaagggcaagtccccggaaaagctcaaggctgagatcgctgagaaactggatgcctggagcaagaagactcatgttgctgtagcgttcgactattccgtggccgagccgatgtatcgcaaccccgagggtgagtgggtcaaggcgctgcttgccgtagccagcgaaaacctcggtatgaaatcggaattcggtacttccgctggtgcgacgtcggttcacgaattgcccaacggcgtgcaattcggcctggcgcgacctgaggccaagtacaccggccacaccgatggcgaattcaagaccgtcgagcagttcctgctggatctgcagatcgtcacggaaatgatgggccgtgtcgggcaattgccgaagctgtaa

SEQ ID NO: 2244 - DNA, 1740 bp, Pseudomonas sp.
atgaatgtccctttcaaaaaactcgcggcgaccacactgatgctggccggcctcgccgtcttcaccacgcctgcacaagccaacatcaccccgcagcaaaccgccgaaatactgaaaagctacaatgccgcgtcggtgagtgatttccatcagttcctcactgaactgggcaaaagcgatctggcgaaaaaagccgagatcagcccggccatcggcgcctatctcgacaaaaaaaacctgaccgctgaacagcagaacgagatctatcgcctgcttggtctctacacgcgggtcaaatacagcgctgcggccaccgaaaccctgcgtgagctggtcgagatcccgacctaccgcaaggacggcgtcgagcagcacgacaacccggaattcatcaagatcgccgcgaagatcaagaacctcgccgagtcgttcggtctgaaattccgcaacatcgacaatcgtgtctacgagatttccctcgacggcagcggcgatgaagttgtgggtattcatgcacacgccgatgtggtgccggtgacgccggaaaactgggtgctcaaggatggcacccgcctcgacccgttcaagatcaccctgatcggtgatcgcatgtacggtcgcggcactgaagatgacaagaacggcatcgtcgtcaccctgtacgcgatgaaggtcatcaaggaagaaaagctgccgctggtgcgcaacttcaagctgctggtcgacaccaccgaagaaaccaccggtgacgcgatcccttactacttcgaacgcaatccgacacccaactacaacctcgcgctggacggcggttacccggtggtgatcgccgaaaaaggttacggcacggtcatggccaacttcgccaaacgtaaaggcgaaggcaaaggtgcggaaatcgttgcgttgaccggcggcatggcgaccaaccagattccatcggcctcggtcgccaccttgctcaccgaccagcccgcgcaactggcggccagtctgcaaaaggccggtagcgagtacgccaagcgcaacggcggcaatttcgaggtcagcgccaaagtcgacggtgagaacgtcaaactgacggtgaccggtgtgtccgcgcactcctccgaacccgagtccggggtcaatccggtggcgcgcatgctcgacttcatcaatagcgttgatggcaaggtcgcgctcaagcacaaccacatcaccgacgccgcccgttacctcgccgacaactggggcctggattatctcggcaacaagctcggcgtcggtttctccgacgcgttcatggggccgctgaccacctcgccgacctttgtcggcatggacgacaagaccttcaaactggcggtcaatctgcgtgtgccgaaaggtaaatcgccggagaaactgaaaaccgaaatcgccgacaaactcgccgcctggagcaagaaaacccacgtcgcggtggcgttcgattattcggtcgcggcgccgatgtaccgcaaccccgagggtgaatgggtcaaggcgttgctggcggttgccacggaaaaccttggcatgaaacacgaattcggcacctccgccggcgcgacttcggtgcatgaactgcccaacggcgtgcagttcggcctggccatgcctgacgtgaaatacaccggccacaccgatggggagttcaagaccgtcgagcaattccagttggacctgcagatcgtcaccgaaatgatcggccgcatcggtcaattgccgaaactctga

SEQ ID NO: 2245 - DNA, 1740 bp, Pseudomonas sp.
atggatttctctctcaagcacctggctgcggccaccctgatgctcgccagcctgtccgcgttcaccagcagtgcccaggccaacatcaccgcgcagcaaagcgcggccatcctcaagaccttcagcgacgccccggccggtgacttccgccagttcctcggcgccctggccaagagcgaaacgggcaagagcgccaacctgggtccggccatcgccgccttcctcgacaaacagtccctgagcgccgaacagcagaacgaaatccatcgcctgctgggtatctacgcccgggtcaagtacggccaggccgccacccaaaccctgcgcgaactggtggccatccccaccttcaacatcgacggcgtgccgcaatacaagaaccccgagttcctcaagatcgccgccaagatccaggacctggccaaggccttcaacctgaactttcgcaacgtcgacaaccgggtctacgagatttccctggaaggcagcggtgaggaagtcgtgggcatccacgcccacgccgacgtggtgccggtgaccccggagaactgggcgctggaagacggcacccgcctcgacccgttcaaggtcacccagatcggcgaccgcctgtatggccgcggcaccgaggacgacaagaacggcatcgtggtcgcgctctacgcgatgaagatcatcaaggaagagcagctgcccctggccaggaacttcaaactgctggtggacaccaccgaggaaaccagcggcgacgcgattccctactacttcgagcacaacccggtgccgcaatacaacctggccctggatggcggctacccggtggtgatcgccgagaaaggctacggcacggtgatggcaacctttgcccggcgcgccgccgaaggtaaaggcgccgagatcacccacctcaccggtggcctggcgaccaaccagatcccctccacctcggtcgccaccctgaagagcgacaacccggcgcaactggccgccagcctgcaacaggccggggccgaatacgccaaggcccatggcggcaacttccaggtcgcggccaaggtggcgggccaggacgtgcaattgaccgtcaccggcgtctcggcccactcctccgagcccgagtccggggtcaacccggtggcgcggatgctggatttcatcaacagcctggacgccaaggtcgctctcaagcacaacgccttcaccgacgccgcccgctacctcgccgacaactggggcctggactacctgggcaagcagctgggcatcggttttgccgacgacttcatgggcccgctgaccacctcgccgaccctggtcagcgtggatgaccacgtcctcaagctggcggtcaacctgcgggtgcccaagggcaagaccccggacgcgctgaaggctgaaatcaccgacaagctgggcgcctggagcaagaagacccaggtggcggtgaagctcgacacctccatcgccgcgccgatgtaccgcaaccccgaaggcgaatgggtcaaggccttgctggcggtggccagcgagaacctgggcatggcacacaagttcggcacctccgccggcgccacctcggtgcacgagctgcccaacggcgtgcagttcggcctggcgcgtcccgaggtcaagtacaccggccacaccgacaacgagttcaagacccaggagcagttcctgctggacttgcagatcgtcactgaaatgatgggccgcatcggccagttgcccaagctctga

SEQ ID NO: 2246 - DNA, 1740 bp, Pseudomonas sp.
atgaacctgtcactcaaaaaactggctgcctccaccttgatactggccagtttctcgtcgttcgccagtctggcaaatgccactgtcactgcacaacagagcgctgtcattctccagacattcagtgagacatcggtaaaggatttcaggcagtttctgaacaatctcgccagcgctgatgtggtgaaaactgccgattttggcccggccatcagcgcctttctcgacaacaagcaactttccgcatcgcaacagaacgatattcatcgtctgcttggtctgtatacccgcatgaagtatggcagcgcggctactgaaaccctgcgcgagctggtggcgattcccactgttcgtgtcgacggcgttgcccagcatgaaaacccggcgttcataaagatcgccgacacgatcaagcgcctggccgagggcttcaatctgaagttccgtaacgtcgataaccgtgtgtatgaagtgtcgctcgacggggccggtgacgaagtggtgggcattcatgtgcatgccgatgttgtgccggtcacgctggacaactgggtcttgcctgacggcactcgtctggacccgttcaaggtgacgttgatcggtgatcgcatgtatggacgcggcaccgaggacgataagaacggtatcgtggcggcgctttatgccatgaaagtcatcaaggaagaaaagctgccgctggccagaaacttcaagttgctgatcgataccacggaagaaacggccggcgacgccatcccgtactattttgagcgtaacccgacgcccgcctacaacctggcgctggatggcggttatcccgtcgtgatcgcagaaaaaggctacggcacggtcatggccagctttgctcgacgccaggccgagggcgagggcgccgagatcgtttcaatgaccgggggcatggccaccaatcagattccatcgaagtcggtggccactctggtgaccgacaagcctgccgagctggctgccagcctgcaacaggccggtgccgagtacgtgaaaagtaatggcggcgacttcgaggtcgatgcccgcgtcgacggcaaggacgtcaagctgacggtcaccggtgtatccgcacactcgtcggcaccccagtccggcgtcaacccggtcgcgaggatgctggacttcatcaacagtctgcggggcaaggttgcgctcaaacagaaccagatcaccgacgctgcccgctatgccgctgacaactgggggctcgattatctgggcagcaagttgggcgtcgggttctccgacgacttcatggggcctctgaccgcatccctgacttacgtagcaatggatgaaaaggcgttcaaactggcggtcaatctgcgtgtgccgaagggcaagtccccgcaggtccttaaatccgaaatcgctgaaaagcttgcggcctggagtacaaaaacttctatcaagccagtgtttgactattccatcgccgagccgatgtatcgcaatcccgagggtgagtgggtcaaggcgctgctggctgttgccagtgaaaatctcggcatggagcacacctttggcacgtcggctggtgctacgtcggtccattcattacccaacggtgtgcagttcggtctggcaagacccgaagtcaaatacaccggccatacggataacgagttcaagaccaccggacagttcttgctggatctgcagatcgtcaccgagatgatggggcgtatcgggcagttgccgaagctctga

SEQ ID NO: 2247 - DNA, 1740 bp, Pseudomonas sp.
atgaacctgtcactcaagcaactggccgcaaccgcgctgataatggccagcctttcgtccttcacctgcgtggcgaatgccaacgttactgcacaacagagcacgatcattctcaagactttcggtgagaaatcggtcacggatttcaggcagtttctgaaaagtctgtcctgcactgatgttgtcaaagctgctgattttggcccggccatcaacgcctttctcgacaacaaaacactttccgacgcgcaacagaacgacattaatcgcctgctcggtctgtatacccggttgaagtatggcaatgcggcaaccgacacattgcgtgagctggtcgccattccaaccgcccgtgttgacggcgttgcccagcatgaaaacccggagttcatcaagatcgccaacgcgatcaaaggccttgccgaacgcttcgatctgaaatttcgcaacgtcgataaccgcgtttatgaagtttcgctcgacggggcgggcgatgaagtcgtgggcattcacgtccatgccgatgttgtaccggtcacgccggaaaactgggtgttgccggacggcacgcggctcgatccgttcaaggttacattgattggtgatcgcctgtatgggcgtggcaccgaagacgataagaatggcattgtcgtggcgctctatgccatgaaggtcatcaaggaagaaaagctgccgctggccagaaacttcaagttgctgatcgatacaactgaagagaccacgggtgacgcaatcccctactattttgaacgcaacccaacgcctggttacaacctggcgctggatggcagctacccggttgtcatcgcggaaaaaggttatgggacggtcatggccagtttcgcgcgacgcaacgctgacggcgagggtgctgaaatcgtttcgatgaccggaggtgcggccaccaaccagattccatcgaaatcggtcgctactctgttaaccgacaagcctgcgcaactggctgccagcctgcaacaggccggtgcggattacgtgaaaaacaatggcggcaatttcgcggtcgatgccagcgtcgacggcaatgacgtcaagctgacagtgacgggtgtttccgcgcactcatcggcgccccagtctggagtcaacccggttgcgaggatgcttgacttcatcaacagccttcaaggcaaggtcgcgctcagacataatcagattactgacgctgctcgctatgcagccgacaactggggccttgattatctgggcaacaagttgggcgttggtttctccgacgagttcatggggccgctgaccgcttctcttacctatgtcgcgatggatgaaacagcgttcaaacttgcggtcaacttgcgcgtgcccaagggcaggtctccggaagagctcaaatccgaaatctccgaaaaacttgcagcgtggagcgtgagaaccggcatcaagcctgcgttcgactattccattgccaagccgatgtaccgcaatccagagggcgaatgggtcagggcgctgcttgcggttgccagcgaaaatctgggtatggaacatgcgttcggcacctcggctggcgcgacgtcggtacatgaactgcccaatggcgtgcagttcggtctggcgaggcccgaagtcaaatataccggccacacggacaacgagttcaagacgaccggacagtttctgctggacctgcagatcgttaccgaaatgatggcgcgcatcggtcagttaccgaaactctga

SEQ ID NO: 2248 - DNA, 1677 bp, Pseudomonas sp.
atgaacttcccgttcaagcgccttgctatcgccaccctcgtcctgtccgccctgtcgtccttcccgatatccgcgagcgccaacatcacggcgcaacaaagcgcggaattcgccaagaccttcggcgacacctcggtcagcgacttccggcaattcctggccagcgtcgccaagagcgacctcgccaagacagccaacctcggcccggccatcaacgctttccaggacaacaaaaccctgtccgccgagcagcagaacgaaatccatcggctgctgggcctctacgcccgcgtgaaatacggcaaggccgccaccgagaccttgcgccaattggtggagatcccgacctatcgcaaggacggcgtggcccagcatgaaaaccccgaattcctgaagatcgccgacaagatccagagcctggccaaagacttcaacctgaactttcgcaacatcgataaccgcgtctacgagatttccctcgaaggcagtggtgacgaagtcgtgggcattcacgcccacgcagacgtggtgccggtgacgccggaaaactgggtgctcaaggacggcaccagactcgatccgttcaaggtcacgctggtgggtgatcgcatgtacggtcgaggcaccgaggatgacaagaacggcatcgtcgtggcgctctacgccatgaagatcatcaaggaagaaaaactgccgttggcgcgccatttcaagctgctggtcgataccaccgaagaaaccaccggcgacgccattccctattatttcgagcgcaacccgacgccgaactacaacctggcgctggatggcagctacccagtggtgatcgccgaaaaaggctacggcacggtcatggcgaagttccctcgtcgcgcgggccagggcaaaggcgccgaaatcaccgcgctgactggcggcatggcgaccaaccagatcccatcgacctcagtggcaacctttgcgacggacaaccccgccgatctggccgccagcctgctcaaggctggcaccgactacgccaaggccaatggtggagactttgaagtgaaaagcgaggtggccgcaaaaacggtcaagctgaccttcaccggcgtttccgcccactcttccgagcccgagtcaggggtcaacccggtcgccagaatgctcgacttcatcaacggcctcgacggcaaggtcgcgctcaagcacaaccacattaccgacgccgcccgctacgccactgacaactggggcctggattacctgggcaagaaactgggcatcggcttcgccgacgagttcatgggcccgctgaccgcctcgctgacctacgtcgggatggatgacaagaccttcaagctcgccgtgaacctgcgggtgcccgtgggcaagccgaccgaagcgctgaaggcggagatcaacgacaagctttccgcctggaccaagaaatccaaggtcgcggtggcgttcgacaactccattgatgcaccgatgtaccgcaaccccgaaggcgaatgggtcaaggcgctgctggccgtcgccaccgagaacctgggcatggagcacaagttcggcacctccgccggcgccacgtcggtccatgacttgcccaacggcgtgcagttcggcctggccatgcccgacgtcaagtacaccggtcacaacgacaacgagttcaagaccgtggagcagttc

SEQ ID NO: 2249 - DNA, 1806 bp, Pseudomonas sp.
ttggaaagcatcctgatcaaacgatcagaaaattcgcgctttgcctgccaaggaatgccttcaataatgaacctgtcactcaaacacctggccgcaaccaccttgatactcgccagtctttcgtcgttcaccagtctggcaaatgccaatgtcaccgcacaacagagcgccgtcatcctcaagacgttcaacgatacatcggtaaaggatttcagacagtttctgacaagcctgtccgataccgagggtgttaaaacggccgactttgctccggccatcaccgcctttctcgataacaaaacactttccgaagcgcaacaaaacgatattcatcgcctgctcggtctgtatacccggttgaggtatggcagtgcggcaaccgaaacgttgcgtgaacttgtcgccattccaaccgcgcgcgtcgacggtgtggctcagcacgaaaaccccgaattcatcaagatcgccaacgcgatcaaagccattgccgaacgcttcaatctgaaattccgcaacgtcgataaccgtgtttatgaagtctcgctcgacggtgcgggcgatgaagtcgtgggtattcacgtccatgccgatgtggtgccggtcacgcctgagaactgggtgttgcccgatggcactcgactggacccgttcaaggtcacgctgatcggagaccgcctgtatggacgtggcaccgaagatgataaaaacggcatcgtcgtggcgctttatgccatgaaagtcatcaaggaagaaaagctgccgctggccagaaacttcaagttgctgatcgatacaactgaagaaaccaccggtgacgccattccctattactttgaacgcaatccgacacccgcctacaaccttgcgctggatggcagctatccggttgtgatcgcggaaaaaggttatggcacggtcatggccagctttgcccgacgcactgcagaaggcgagggtgctgaaatcgtctcgatgaccggtggtatggccactaaccagattccgtcgaaatcggttgtcacgctggtgaccgataaacctgcagaactggccgccggcctgcaacaggccggtgccgaatacgtgaaacgcaatggtggggatttcgacgtcgatgccaaggtcgacggcaatgacgtcaagttgacagtgaccggtgtttccgcgcactcatcgtcgccccagtccggcgtcaacccggtcgcgaggatgctgggctttatcgacagccttcaaggcagggtcgcgcttaaacataaccagattacggatgccgctcgctatgctgccgacaactggggacttgattatctgggcagcaagttgggcgttggtttctccgacgacttcatggggccgctgaccgcttcccttacctacgtcgcgatggatgagaaagcgttcaaactggcggtcaacttgcgcgtgcctaagggcaggtcgccggaagcgctaaaatccgcaatcgccgaaaaactggctgcctggagctccaagaccggtatcaaaccagcgttcgactattcgattgccaagccgatgtaccgaaacccggaaggcgagtgggtcaaggcgctgctcgctgttgccagtgaaaacctggatatgaagcacgcattcggcacctcggctggtgcgacatcggtacatgagttgcccaatggcgtgcagttcggcctggcgcggcccgaagtcaaatacaccggtcataccgataacgagttcaagacgaccggacagtttctgctggacctgcagatcgtcacagagatgatgggacgcatcggtcagttgccaaaactctga

SEQ ID NO: 2250 - DNA, 1920 bp, Pseudomonas sp.
gtgcaccacttcaagtgccctcaaacgggtttgcatatctgcgtcgcttttgaccggcaaggcgacaggaagcgtttggcaggctcccgcattcatcctgtgaggtgttattttgaggacgtttctgatcacatgatcagctatttcccacacactcttcgcaaaggaatgcccttagcaatgaacctttcactcaagcatctggccgcttccacactgatgctcgccagcctttcagccgtcgccccctccgctctggcgaatatcacgccgcaacaaagcgccgccattctgaaaacattcaatgaaaagtcggcgactgatttcagacagtttctggggagcgtcgcgaagagcgatctggccaaaactgccgatctcgaacccgcgatcagtgcctttctcgacgacaagactctgaccgccgaacagcagaacgaaatccatcggctgctgggcatttacgcccgtgtgaagtacggcagtgctgcgaatgaaaccctgcgtgaactggtcgccatcccgacctttgccgttgaaggcgtcgcccagcacgacaatcccgagttcatcaagatcgccgagaagctcaagacgctcgccgagtcgttcaatctcaaattccgcaacatcgacaaccgcgtctatgaagtctcgctcgagggctccagcgaggaagtcgtcggtattcatgcccacgctgacgtggtgccggtgacgcctgcgaactgggtgctgccggacggtaccaaactcgacccgttcaaggtcacgttgattggcgaccgcatgtacggtcgtggcaccgaggatgacaagaacggcatcgtggttgcgatgtacgccatgaaagtcatcaaggaagaaaagctgccgctggctcgaaacttcaagctgctgatcgacaccaccgaagagacctccggcgacgcgattccgtactacttcgagcgcaacccgacgccgaactacaacctggcgctggacggcggttacccggtggtcattgccgagaaaggttacggcaccgtgatggcgaatttccctgtgcgtaagggtgagggcaagggcgccgaaatcacctcgttgaccggcggcgcggcgaccaatcagattccatcgaaatcggtcgccacgctggtgacggacaaacccgcagaattggccgctgagctgcaaaaggcgggtgccgagtacgcgaagcgcaacggtggcgacttccaggtggacgcagcggtcgagggtaaggacgtgaagctgaccgtcactggcgtatcggcccactcgtccgatcctgcgtcgggcgtcaacccggtggcccgaatactcgacttcatcaacagcctcgacggcaaggttgagttgaagcacaaccacatcaccgacgcggctcagtatgcggctgacaactggggtctggattatctgggcagcaaactgggggtcggtttctcggacgagttcatgggcccgctgaccgcttccctgaccttcgtggggatggatgcgaagaccttcaaactcgcggtgaacctgcgcgtgccgaaaggcaagtcgcctgagaagctcaaggccgagatcgccgaaaagctgacggcatggagcaagcagagcaagattgcgcctgcgttcgattactccatcgccgaaccgatgtaccgtaaccctgagggtgaatgggtcaaagcactgctggccgtctctaccgaaaacctgggcatgccccacacgttcggcacctcggcgggcgctacctcggtccacaacctgcccaacggcgtgcagttcggcttggccatgcccgaagccaaatacaccggacacaccgacagcgagttcaagaccaccgagcagtttctgctcgacctgcagatcgtgacggaaatgatggggcgtatcgggcaattgccgaagctttga

SEQ ID NO: 2251 - DNA, 1863 bp, Pseudomonas sp.
attgtccgaggcgaaagaggaaaacagggattctcgcatcattgttcttggtgtaagttgaaaagcttgctgatcaaacgatcagaacattcgcgctttgcttgccaaggaatgccttcaataatgaatctgtcactcaaaaaactggctgcctccaccttgatcctggccagtctctcgtcgttcaccagtctggcaaacgccactgtcactgcacaacagagcgccgtcatcctcaagacgttcagtgatacgtcggtaaaggatttcaggcagtttctgaacagtctggccaacgctgatgtggttaaaactgccgattctggcccggccatcagtgcctttctcgataacaaaccactttccgcagcgcaacaaaacgatattcatcgcctgctcggtctgtatacccgcatgaagtacggcagcgcggcgactgaaaccctgcgtgagctggtggcgattcccacggttcgtgtcgacggcgttgcccagcacgaaaacccggccttcataaagattgccgacaagatcaagagccttgccgaaggcttcgatctgaagtttcgtaacgtcgataaccgtgtgtatgaagtgtcgctcgacggagccagtgatgaagtggtgggcattcatgtgcatgccgatgttgtaccggtcacgctggacaactgggtcttgcctgacggcactcgtctggacccgttcaaggtgacgttgatcggtgatcgcatgtacgggcgcggtaccgaagacgacaagaacggtattgtggtggcgctctatgccatgaaagtcatcaaggaagaaaaactgccgctggccagaaacttcaagctgctgatcgataccacggaagaaaccgccggcgacgccatcccttactattttgagcgtaacccgacgcccgcctataacctggcgctggatggcggttatcccgttgtgatcgcagaaaaaggttacggcacggtcatggccagctttgcccgacgccaggcagaaggcgagggtgccgagatcgtttcaatgaccgggggtatggccaccaatcagattccatcgaagtcggtcgccactctgctgaccgacaaacctgccgagcttgctgccagtctgcaacaggccggagccgagtacgtgaaaagcaatggcggtgactttgaggtcgatgccagggtcgacggcaaggacgtcaaactgaccgtgaccggcgtatccgcatactcatcggcgccccagtccggggtcaatccggtcgcgaggatgctggatttcatcaacagcctgcagggcaaggttgcgctcaaacataaccagatcacggacgctgctcgctatgccgccgacaactgggggctcgattacctgggcagcaagttgggcgttgggttctccgacgacttcatggggcctctgaccgcatcactgacgtacgtcgcaatggatgaaaaggcattcaagcttgcggtcaatctgcgcgtgccgaagggcaagtccccacaggtgctcaaatccgaaatcgccgaaaagctggcggcctggagtacgaaaaccgcgatcaagccagcgttcgactattccattgccgagccgatgtaccgcaatcccgagggtgagtgggtcaaggcgctgctcgctgtcgctagtgaaaatctcggtatggaacacacctttggcacgtcggctggcgcgacgtcggtccattcattacccaacggtgtgcagttcggcctggcgagacccgaagtcaaatacaccggtcatacggataacgagttcaagaccaccgggcagttcttgctggatctgcagatcgtcaccgagatgatggggcgtatcggacaactgccgaagctctga

SEQ ID NO: 2252 - DNA, 1731 bp, unknown
  environmental sample
atgcacctgaaaaaactcaccgccaccaccctgctgctggccagcatcggcctgttcacccagccggcccaggccaacctcacccatcagcagtccgctgccatcgtcaaagcttttgacggcagcaacccaagcgacttcaagcagttcctcggcaagctcaaaggcagcgacctggccaaggccgacaacctcgaggcaaccctcgacgcctacctggccagcaagccactggccgccgagcagcaagacgagatcaaccgcctgctcggcctgtatacccgcatcaagtatggcaaggccgccaccgaaaccctgcgcgagctggtggccatccccaccttcaatgtcgagggtacgccgcagtaccaaaaccccgagttcctcaagattgccgacaagatcaaggccctggccgacagctttggcctggccttccgcaacatcgacaaccgggtgtacgagatttcgctcggcagcggcaaggaagtaatcggcatccacgcccatgccgacgtagtgccggtcaacccggacaactggaagctggccgacggcacacgcctggacccgttcaaggtcaccctggttggcgaccgcatgtacggccgtggtaccgaagacgacaagaacggcatcgtggtggcgatgtacgcgctcaaagtggccaaggacgagaacctgccgctggcccggcagttcaagctgctgatcgacaccaccgaagaaaccagcggcgatgccatcccctactacttcgaacgcaaccccacccctgactacaacctggccctcgacggcggctacccggtggtgatcgccgagaaaggctacggcacggtcatggccagcttcagcaagcgggcggccactggcaagggcgcagaaatcgtcaacctgactggcggcctggccaccaaccagatcccgaccacttcggtagcgaccctggtttcagagaacccgacgcagctggccaaacagttgcagcaagccggtgccaagtacgtgaagcagcatggcggcgacttcagcatcgacgccaaagcagagggcaagaacgtgctgctcacggtgaccggtgtttccgcccactcttcggagccggagtccggggtgaacccggtggcccgtatgctcgacttcatcaacggcgtgggcaagcaggtatcgctcaagcacaaccacttcaccgacgccgcccgctatgctgccgacaactggggcctggactacctgggcaacaaactcggcgtggcgttcaaggacgcattcatgggcccgctgacggcctcgctgacgtttgtcggggtggatgacaatggcctgaaactggcggtgaacctgcgtattccgaagggcaagccaatcgccacgatcaaggacgaactggctgacaaactgggcaagtggacccgccaaagccacacctcggtagccttcgactacagcctggacgagccgatgtaccgcaaccccgaaggcgaatgggtcaaggccctgctcgcggtggccaccgagaacctgggcatgaagcatgagttcggcacctcggccggcgcaacctcggtgcacgacctgcccaacggcgtgcagttcggcctggccatgccggacgtgaagtacaccgggcacaacgacaacgagttcaagacggtggagcagttcatgctggatctgcagatcgtgagcgagatggtcgcgcggcttgggcagatgccgaagctctga

SEQ ID NO: 2253 - DNA, 1731 bp, Pseudomonas sp.
atgcacctgaaaaaactctctgccctgactctgttgctggccagcatcggcctgttcacctcgcaggctcaagccaatctttcccagcagcaatcggccgccatcctcaaagcctacgacggcagcgacccggccgacttcaagcaatttatcggcaagctggccagcagcgacctggccaaggccgacaacctgggtgacaccctcaaggcctacctggccggcaagccgctggccgccgaacagcacaacgagatcaaccgcctgctcggcctgtatacccgcatcaagtacggcaaggccgccactgacaacctgcgcgagctggtcgcgatcccgacttttcaggtcgaaggcgtagcccagcatgacaatccgcaatttcacaagatcgccgacaagatcaaagccttggccgagagcttcggcctgacgttccgcaacatcgacaaccgggtctacgagatcacgctcggagaaggcaaggaagtggtcggcattcatgcccacgccgacgtggtgccggtcaatccagacaactggaagctcgacgacggcactcaccttgacccgttcaaagtcaccctggtgggtgatcgcatgtacggccgcggcactgaggatgacaagaacggcatcatcgttgcgctgtacgccatgaaagtcgccaaggacgagaagctgccgctggctcgccaattgaagctgctggtcgataccaccgaggaaaccaccggtgaggccatcccctattacttcgaacgcaacccggtgccggactacaacctggcactggacggcggctacccggtggtcatcgccgagaaaggctccggcgcggtaatggccaccttcccccgccgcgcagccagcggccaaggtgccgagctcaccagcctgacgggtggcctggccaacaaccagatccccaccacttcggtggtgaccctgattggcgacaaccctgccgatctcgccgctcgcctgaacaaagccggtgcgcagttcgtgaaggataacggcgctaacttcagcatcgaggcgaaagtcgaaggcaagcaagtgctgctgaccagcaaaggcgtctcggcgcactcttccgagcctgagtccggggtcaatccggtcgcgcgcatgctggtgttcatcaacgggctgggtgagcaagtgccgctcaagcacaaccacatcaccgacgcagcccgctacgccgccgacaattgggggctggactacaccggcaagaagctgggcattggctttgaagattcattcatgggcccgctgacggcctcgccgaccttcgttggcctggatgacaaagccctgaaattggcggtcaacctgcgcgtccctaaaggcaagtcggtcgacacgctcaaggccgaactgaccgacaagctcggtgcttgggtcaaggccagcgctgtggcagtgtccttcgacaccaacctcgaccagccgatgtaccgcaatcctgaaggcgaatgggtcaaggccctgctcgcagtagccagcgagaacctcggcatgcctcatgagttcggcacttctgccggcgccacttcggtgcatgacctgccaaatggcgtgcagtttggtttggccatgcccaacgtgaaatacaccgggcacaacgacaacgagttcaagactgtggagcaattcatgctggacttgcagatcgtcagtgagatggtcgcgcggattgggcagatgccaaaactttga

SEQ ID NO: 2254 - DNA, 1731 bp, unknown
  environmental sample
atgcatctgaaaaagctcacctctgtttccctgctggcagccagcatcggcttgttcgcgttgcctgcccaggccaacctcacccagcagcagtctgcggcgatcgtcaaggcgttcgacggcagcgatccgcatgacttcaagcagtttctcggcacgctcaaaggcagcgatctggcccgggccgatgacctgggcgccacgctggacgcctacctggccggcaagccattgaccgccgagcagcagaacgagatcaatcgcctgctcgggctctatacccgcatcaagtacggcaaggctgccacccagaccctgcgcgaactggtggccattcccacggtcaccgtcgagggcacgcctcagcacgagaaccccgagttcctgaagatcgccgataagatcaaggcactggccgacgaattcggcctggcatttcgcaacgtcgacaaccgtgtctacgaaatctccctgggaagcggcaaggaagtggtcggtatccatgcccatgccgacgtcgtccctgtcacaccggaaaactggaagcttgccgacggcacgcgcctggacccgttcaaggtcaccctggtcggtgatcgtatgtacggccgtggtaccgaggacgacaagaatggcatcgttgtagcgctatatgccctcaaggtcgccaaggatgaaaacctgcctttggcgcggcagttcaaactgctgatcgacaccaccgaagaaaccagaggcgatgccatcccgtactacttcgagcgcaatcctacgcctgactacaacctcgccctggatggcgggtatccggtggtcatcgcggaaaaaggctacggcaccgtaatggcgaattttgccaagcgtgcggccagcggccagggggccgaaatcgttaaccttaccggtgggcttgctaccaatcagatcccgtccacctcggtagcgaccttgctcaccgacgacgccagcacactggcgcagcgactgaacacggccggtgccgagtacgtgaaggaacacggtggcgacttcagcatcgccgccaaacccgacggcaagcaggtggtgctcaccgtgaccggtgtgtcagcgcattcctcggagcccgaatcgggcgtgaaccctgtcgcgcgcatgctggacttcatcaatggcgtgggcacgacggtgccattgaagcagaaccagttcaccgatgctgcccgctatgcggcggacaactggggcctggactatttgggcaagaagctgggcatcgcctatgacgatgcattcatggggccgcttaccgcctcgcccaccttcgtcggtgtggatgacaaaggcttgaagctggcaatcaacctgcgcattcccaagggcaaggcggtcgcaacgatcaagggtgaaatcgccgacaagctcggcaaatggtcgcagcaaagccatatcacgcccgcctacgactacagcctggacgagccgatgtaccgcaacccggaaggtgagtgggtcaaggcactgctggccgtggccagcgaaaacctgggcatgaagcacgcgttcggtacgtccgccggagccacttcagtgcatgacctgcccaacggcgtgcagtttggtctggccatgcccggtgtgaagtacaccgggcacaacgacaacgagttcaagacagtggaccagttcatgctggacctgcaggtggtcagcgaaatggtggcgcgaatcgggcagatgccgcagctctga

SEQ ID NO: 2255 - DNA, 1989 bp, Serratia sp.
atgcctctaaaaataactcgcatgccccgcccggcggtgcttgcagtggcgatattatgcagtatgacgaccccggcgctggcctatgaccaggtttacgtatttggcgatagcctgagcgataccggcaacaatggccgctttacctacgacggcaataaacacctgctgtatgacgaagtgctggcggaacgcatcggcgccgcgttggtggcgtcggacgacggcggctacaattatgccgccggcggcggtgtggcggtgccggcgctcaacccggcggacaatactcaggatcaggtgcagagctaccttggccgggtcgatggccgggccgatggcgacggtctgtatattcactggattggcggcaacgatctggcggcggcggcgttaaacccgacaaccgcgtcggacgtggcctataacagtgcagccgccgccgcagtgcaggttcgttcgctgttgaatgccggcgccggtacggtgatcgtaccgacggtaccgaatattggttcaacgccgcagctgatggagctgattatccagcaggcgctgacgccggtgcagggagccgcagtacaggcggcctatgccaccctcaattcgctgactacgccggataatgtttcgcgcacccaggctatccatcaggcgctgatttccgccgccgcacaggccagcgcaatcccgcaggtgcagcaggcgatcgccgcacagctgattgccgcctttgacggcctgagcgctcaggccgcgcagttgaccgatttttataaccagagtgaggatcgcctgctggcgcagggcggtggcaatgttgttcgcgtcgacgtgaacaagctgttcgccgaggcgatagccaatccggcgcagtttggcttcgccaataccgccggcatggcttgtccggccggggtgtcgtcggcggtgtgcagctccgccacgccgggcttcgacgccagtcagtcctatttgttctccgatcattttcaccccagcccgcaggcgcatctgttgattgccgattacattcaggcggtgctggatggcccggcgcaggtggtggcgctgaatcaggcgacggcggcgatggcgcgtgacagccgcgcgacgctcgacagccgtttccagcaattgcgcaatggcgacaacccgcagggatcgctgggcgtcttcggtggctatgccgggcagcattatgattactcggccaataaggcggcgggcgacggcaacgccaccacccataatctggcggttggggtagattatcagttggccgaaggctggctgattggcgcgctgatatccggctccaatgacgatcagcagccgtccagccgctatgaatacaaggcgcgtggcctgctgttgtcggcctttaccgcccttgatctgtttgagcacggctgggtgaatgccgatctgcactacgcgacgatggattacgacgatattcgccgcagcatgcagctcgggccgctaacccgcacagaaaccggctcgacctccggcaagcagtggggcgcacgcctcaccgccggttatgatttcccgatcacctcttatctgacgaccggtccaatggcgcagtttgcctgggattacagcaacgtctccggttacagcgaggatggcaacaacagtacctcaatgcgctttaacgaccagacctatcattcgcagatcggcgcgttgggctggcggctggacagccaatttggcctgtttaatccgtatgccgaggtgagctatcagcatcagtttggcgacgatgtctatcgggccggcggtgggctgaagtccacgcaaacctcgttcacccgcgacagcgccggccaggataaaaactgggtggatgtgacgctgggggcgaacatgccgctgaccgatcaggtggcggcgttcgccgccgtttcgcaaaccggtggtctgagcagcggcgagcagtttatgtataacgttggcgtcagcgcgcggttttga

SEQ ID NO: 2256 - DNA, 1989 bp, Serratia sp.
atgcctctaaaaataactcgcatgccccgcccggcggtgcttgcagtggcgatattatgcagtatgactgccccggcgttggcctatgaccaggtttacgtatttggcgatagcctgagcgataccggcaacaatggccgctttacctacgacggcaataaacacctgctgtatgacgaagtgctggcgcaacgcatcggcgcggcgttggtggcatcggacgacggtggctacaactatgccgccggcggcggtgtggcggtgccggcgcttaacccggcggacaatactcaggatcaggtgcagagctaccttggccgggtcgatggccgggccgatggcgagggtctgtatattcactggattggcggcaacgatctggcggcggcggcgttaaacccgacaaccgcgtcggacgtggcctataacagtgcagccgccgccgcagtgcaggttcgttcgctgttgaatgccggcgccggtacggtgatcgtaccgacggtaccgaatattggttcaacgccgcagctgatggagctgattatccagcaggcgctgacgccggtgcagagcgccgcagtacaggcggcctatgccaccctcaattcgctgactacgccggataatgcttcgcgcacccaggctatccatcaggcgctgacttccgccgccgcacaggccagcgcaatcccgcaggtgcagcaggcgatcgccgcacagctgattgccgcctttgacagcctgagcgctcaggccgcgcaactgaccgatttttataaccagagtgaggatcgcctgctggcgcagggcggtggcaatgttgttcgcgtcgatgtgaacaagctgttcgccgaggcgatagccaatccggcgcagtttggcttcgccaataccgccggcatggcttgtccggcaggggtgtcgtcggcggtgtgcagttccgccacgccaggcttcgacgccagccagtcctatttgttctccgatcattttcaccccagcccgcaggcgcatctgttgattgccgattatattcaggcggtgctggatggcccggcgcaggtggtggcgctgaatcaggcgacggcggcgatggcgcgtgacagccgcgcgacgctcgacagccgttttcagcaactgcgcaatggcgacaacccgcagggatcgctgggcgtcttcggtggctatgccgggcagcattatgattactcggccaataaggcggtgggcgacggcaatgccaccacccataatctgacggttggggtagattatcagttggccgaaggctggctgattggcgcattgatatccggttccaatgacgatcagcagccgtccagccgctatgaatacaaggcgcgcggcctgctgttgtcggcctttaccgcccttgatctgtttgagcacggctgggtgaatgccgatctgcactacgcgacgatggattacgacgatattcgccgcagcatgcagctcgggccgctaacccgcaccgaaaccggctcgacctccggcaagcagtggggcgcacgcctcaccgccggttatgatttcccgatcacctcttatctgacgaccggcccaatggcgcagtttgcctgggattacagcaacgtctccggttacagcgaggatggcaacaacagtacctcaatgcgttttaacgaccagacctaccattcgcagatcggcgcgttgggctggcggctggacagccaatttggcctgtttaatccgtatgccgaggtgagctatcagcatcagtttggcgacgatgtctatcgggccggcggtgggctgaagtccacgcaaacctcgttcacccgcgacagcgctgggcaggataaaaactgggtggatgtgacgctgggggcgaacatgccgctgaccgatcaggtggcggcgttcgccgccgtttcgcaaaccggcggcctgagcagcggcgagcagtttatgtataacgtcggcgtcagcgcgcggttttga

SEQ ID NO: 2257 - DNA, 1989 bp, Serratia sp.
atgcctctaaaaataactcgcatgcaccgcccggcggtgcttgcagtggcgatattatgcagtatgactaccccggcgctggcctatgaccaggtttacgtatttggcgatagcctgagcgataccggcaacaatggccgctttacctacgacggcaataaacacctgttgtatgacgaagtgctggcgcaacgcatcggcgcagcattggtggcgtcggacgacggtggctacaactatgccggcggcggcggtgtggcggtgccggcgcttaacccggcggacaatactcaggatcaggtgcagagctaccttgtcagggccaatggccgggccgatggcgacggtctgtatattcactggattggcggcaacgatctggcggcggcggcgttaaacccgacaaccgcgtcgggcgtggcctataacagcgcagccgccgccgcagtgcaggttcgttcgctgttgaatgccggcgccggtacggtgatcgtaccgacggtaccgaatattggttcaacgccgcagctgatggagctgattatccagcaggcgctgacgccggtgcagggtgccgcagtccaggcggcctatgccactctcaattcgctgactacgccggataatgcttcgcgcacccaggctatccatcaggcgctgacttccgccgccgcacaggccagcgcaatcccgcaggtgcagcaggcgatcgccgcacagctgattgccgcctttgacagcctgagcgctcaggccgcgcaactgaccgatttttataaccagagtgaggatcgcctgctggcgcagggcggtggcaatgttgttcgcgtcgatgtgaacacgctgttcgccgaggcgatagccaatccggcgcagtttggcttcgccaataccgccggcatggcttgtccggctggagtgtcgtcggcggtgtgcagttccgccgcgccaggcttcgacgccagccagtcctatctgttctccgatcattttcaccccagcccgcaggcgcatctgttgattgccgattacattcaggcggtgctggatggcccggcgcaggtggtggcgctgaatcaggcgacggcggcgatggcgcgtgacagccgcgcgacgctcgacagccgtttccagcaactgcgcaatggcgacaacccgcagggtgcgctgggcgtcttcggcggctatgccgggcagcattatgattactcagccaataaggcggcgggcgacggcaacgccaccacccataatatgacggttggggtagattatcagttgaccgaaggctggctgattggcgcgctgatatccggttccaatgacgatcaacagccgtccagccgctatgaatacaaggcgcgcggcctgttgctgtcggcctttaccgcccttgatctgtttgagcacggctgggtgaatgccgatctgcactacgcgaccatggattacgacgatattcgccgcagcatgcagctagggccgctaacccgcaccgaaaccggctcgacctccggcaagcagtggggcgcacgcctcaccgccggttatgacttcccgatcaccgcttatctgacgaccggcccgatggcgcagtttgcctgggattacagcaacgtctccggttacagcgaggatggcaacagcagtacctcaatgcgttttaacgaccagacctaccattcgcagatcggcgcattgggctggcggctggacacccaatttggcctgtttaatccgtatgccgaggtgagctatcagcatcagtttggcgacgatgtctatcgggccggcggtgggctgaagtccacgcagacctcgttcacccgcgacagcgccagccaggataaaaactgggtggatgtgacgctgggggcgaacatgccgctgactgaccaggtggcggcgttcgccaccgtttcgcaaaccggcggcctgagcagcggcgagcagtttatgtataacgtcggcgtcagcgcacggttttga

SEQ ID NO: 2258 - DNA, 1989 bp, Multievos46 sp.
atgcctcttaaaataacctgtctgccccgcccggcggtgcttgcagtggcgatattatgcagtatgacgaccccggtgctggcttatgaccaactctacgtcttcggcgacagtctgagcgataccggtaacaatggccgctttacctacgacagcaataaacatctgttatacgacgaagtactggcgcaacgcatcggcgcggcgttagtggcttcggacgatggcggcaataactacgccgccggcgggggcgtggcggtgccggcactcaacccggcggacaatacgcaggatcaggtgcagagctacctcggtcaggtcaatggacgggctgacggcgatggcctgtatatacactggattggcggcaacgacctggcggcggcggcattaaacccgacgaccgcgccgggcgtagcctacaacagcgcagcggcggcggccgcgcaggttcattcattgctgaatgccggtgccggtacggtgatcgtgccgacggtgccgaatattggttccacgccgcagttgatggagctgatcatccagcaggcgttgacgccggtgcaaaacgcagcggttcaggcggcctacgccaccctgaattcgctggccacgccggataacgcttcacgtaccgaggctatccatcaggccctgacggcggcagcggcgcagggcagcgcgatcccccaggtgcagcaggcgattgccgcacagctgatagccgcttatgacagcctcagcgcgcaggcggcacaactgaccgatttctataaccaaagcgaagaccacctgctggcgcaggggggcgggaacatcgtccgggttgacgtgaacaaactgtttggcgaggcgattgccaacccggcgcagtttggcttcaccaataccgcaggcatggcctgtccgccgggcgtctcctctgcggtgtgccgttctaccatgccgggttttgatagcagccaggcctacctgttcgccgaccatttccaccccagcccgcaggcgcatctgttgattgccgattacattcaggcggtgctcgacggtcctgcgcaggtggtggcgctgaatcaggcgacggcggccatggcgcgtgacagccgtgctaccctcgacagccgttttcaacagctgcgcagtggcgaaaacccgcaaggatcgctgggcgttttcggaggctatgccgggcaacactatgattattcttccaatctggcggcgggcgacggcaatgccactactcataatctgacggtaggggtggattaccagttgaccgacggctggctgatcggcgcgctgatttccggctccaatgacgatcaacagccctccagccgctacgactacaaagcgcgtggcctgttattttccgcctttaccgcccttgatctgtttgaaaacggttgggtgaatgccgatttgcactatgcgacgatgaattacgatgatattcgccgcagcatgcagcttggggcgttaacccgtaccgaaaccggcagcaccgacggcaagcaatggggagcgcggatcaccgccggttacgatttccccgtcacctcttacctgaccaccggaccgatggcacagtttgcctgggattacagcaacgtctccggttacagcgaagacggcaatgacagcaccgccatgcgctttaacgatcagacctaccattcgcagatcggtgcgttaggttggcggttggacagcaagttcggcctgtttaatccctatgccgaggtgagctatcagcatcagtttggtgatgacgtttaccgtgccggcggtgggctgaagtccacgcagacctcgttcactcgcgacagcgccagccaggataaaaactgggtggatgtgacgctgggggcgaatatgccgttgaccgatcaggtggcggctttcgccaccgtttctcagaccggcggtctgagcagtggcgaacagtttatgtataacgtcggggtcagcgcccgtttttga

SEQ ID NO: 2259 - DNA, 1992 bp, Serratia sp.
atgcctctaaaaataatgtgcatgccccgtccagcggtgcttgcagtggcgatattatgcagtatgacgaccccggcgcaggcctatgaccagctctatgtttttggcgacagcttgagcgacacgggtaacaatggccgttttacctacgacagtaataagcatcagttatatgacgaagtgctggcacagcgaattggtgctgcgttagtggcctcagacgatggcggttataactacgctgcgggtggtggtgtcgcggtaccggcactcaatccggcagacaatactcaggatcaggtacagagctacctcaaccgagtcaatggccgggctgatggtgatggtctgtatattcactggattggcggcaacgatttggcggcggcggcgttaaacccgacaaccgcgccgggggtagcctataacagtgctgctgcggcggctgcgcaggttcactcgctgttgaatgccggcgccggcacggtgatcgtaccgacggtgccgaatattggctctacgccgcagttgatggagctgattatccagcaggtgctgaccccagtgcaaaacgctgcggtacaggctgcttatgccacgctcaattcattggccacgccagataatgcctctcggactcaggccattcaccaagccctgactgctgcagcggcacaaggcagcgcaatcccgcaggtacagcaggccattgccgcgcagttgattgccgcttttgacagcctgagtgcccaggcggggcaactgaccgatttttataaccagagcgaagatcgtctgctggcgcagggcagcggtaatatcgttcgggtcgacgtgaataaactgtttagtgaggcgattgccaacccagcgcagtttggtttcaccaataccgcaggcatggcctgcccgccgggtgtctcttctgcggtgtgcagttcgacaatgcctggtttcgacagtagccagtcctacttgttcgctgaccatttccaccccagcccgcaggcacatcaactgatcgccgattacattcaggcagtgctggacggcccggcgcaggttgtggcgctgaatcaggcgacggcggccatggcgcgtgacagccgcgctaccctcgacagccgtttccagcagttgcgcagtaacgataataacccgcaaggggctttgggcgtgttcggtggttatgccggacaacactatgattactcttccaatcttgcggcaggtgatggcaacgccactacccataatttgacgattggggtggattaccaactgacagatgcctggctgatcggtgcattgatctctggctccaatgatgatcaacaaccatccagtcgctatgaatacaaagcgcgtggtctgctgttttctgcttttacttctctcagcgtgtttgagcacggttgggtgaatgctgatttgcactatgcgacgatggattacgatgatattcgccgtagcatgcagcttggatcgctgacccgtactgaaaccggcagcacagacggtaaacagtggggagctcgtgtgactaccggttacgacttccccatcacctcttacctgactacgggaccgatggcgcagtttgcctgggattacagtaatgtctccggctatagcgaggacggcagcgacagcacggcgatgagatttaatgaccaaacttaccattcgcagatcggcgcattgggttggcgactggacaccaaatttggcctgtttaacccatatgctgaagtgagttaccaacatcagtttggtgatgatgtttatcgggctggcggtggactaaaatccacgcagacttcgtttacccgcgacagtgccaaccaggataaaaattgggtggatgtgacggtgggggcgaatatgccactgaccgatcaagtcgcggcgttcgccaccgtttcgcagaccggtgggctgagtagtggcgaacagtttatgtataacgtcggtgtcagtgcgcgattctga

SEQ ID NO: 2260 - DNA, 1989 bp, Serratia sp.
atgcctctaaaaataacatgcatgccccgcccggcggcgcttgcagtggcgttactttgcagtgtgacccttccggttcaggcgtatgaccaactctacgtctttggcgacagcctgagtgataccggcaacaacggccggttcacctatgacggcagtcagcacctgctgtacgacgaagcgttggcgcaacgcatcggcgcggcgctggtggcctcggacaacggcggtgaaaactacgccgccggcggcgccgtggcggtgccgggcctgaacccggtcgacaacactcaggatcaggtgcagcgctacctgaatcgggttaacggccaggccgatggcgacggtttgtatattcactggatcggcggtaacgatttggcggcggcggcgctgaacgccgctaccgcgcccggcgtggcctataacagcgccgcggccgccgccgcgcaggtgcattcgctgctgaacgccggcgccggcacggtgatcgtgccgacggtgccgaacatcggctccacgccgcagctgatggagctgattattcagcaggcgctgccgccggtacagggggcggcgattcaggcggcctatgccacgctcaattcggtggcaaccccggacaacgcttcgcgcacgcaggcgatccacgcggcgttggccgccgcggcgaagcagggcagcgcgatccctcaggtgcagcaggcgatcgccgcccagcttgtggcggcgtatgacagcctgagcgcgcaggccgctcagctgaccgatttctataatcaaagcgaagaccgtttgctggcgcaggggggcggcaatatcgtgcgggtggacgtgaacaagctgttcgccgaagcgatcgccaatccggcgcagttcggcttcgccaacacggccggcatggcttgtccggcgggcgtttcctcggcggtttgccgttccgacatgcccggcttcgacgccggccagtcctatctgttctccgaccatttccaccccagcccgcaggcgcacctgctgattgcggattatatccaggcggtgttggatggcccggcgcaggtggtggcgctgaatcaggcgacggcggcgatggcgcgtgacagccgcgccacgctcgacagccgtttccagcagctgcgcaacggcgacaatccgcagggctcgctgggcgtgttcggcggctacgcaggccagcactatgactatgccgataaccgggcggcgggagatggcaacgccaccacccacaacctgaccgtcggcgtggactatcagctgaccgacagctggttgatcggtgcgttgatcgccggttccaacgacgatcagcatccttccagccgctatgactacaaggcgcgtggggtgctgctgtcggccttcagttcgctggccatattcgagcaggggtgggtcaatgccgatctgcactatgcgacgatggattatgacgacatccgtcgcagcatgcggttggggccgctgacgcgcaccgaaaccggttcgacctccggcaagcagtggggcgcgcgcgtgaccgccggctatgacttccctatcgctgcttacctcaccaccgggccggtggcgcagttcgcctgggattacagtcatgtgtccggctacagcgaagacggtgatgacagcaccgccatgcgcttcaacgatcaaacctatcattcgcagatcggcgcgttgggctggcggttggatacgcaattcggcgtgtttaacccctatgcggaagtgagttatcagcatcagttcggcgatgacgtctaccgcgccggcggcggcctgaaatcgacgcaaacctcatttactcgcgacagtgcgggtcaggacaaaaactgggtggatgtcacgctgggggccaacatgccgttgacggacagagtgtcggccttcgccaccgtctcgcaaaccggcggcctgagcagcggcgagcagtttatgtataacgtcggcgtcagcgcgcgcttctga

SEQ ID NO: 2261 - DNA, 1989 bp, Serratia sp.
atgcctctaaaaataacgtgcatgccccgcccggcggcgcttgcagtggcgttgctttgcagtgtgacccttccggctcaggcgtacgatcaactctacgtctttggcgatagcctgagcgataccggcaacaacggccggttcacctatgacggtaaccagcacctgctgtacgacgaagcgttggcgcaacgcatcggggcggcgctggtggcttcggacaacggcggtgagaactacgccgccggcggcgccgtggcggtgccgggcctgaacccggccgacaacacccaggatcaggtgcagcgctatctgaaccgggtcaacggccaggccgacggcgacggtttttacgttcattggatcggcggcaacgatctggcggcggcggcattaaatgccgctaccgcgcccggcgtggcctataacagcgccgccgcggcagccgcgcaggtgcattcgctgctgaacgccggtgccggcacggtgatcgtgccgacggtgccgaacatcggctccacgccgcagctgatggaattgatcattcaacaggcgctgtcgccggtgcagggggcggcgatccaggcggcctatgccacgcttaattcggtggcgacgccggacaacgcttcacgcacgcaggcgatccacgcggcgttggccgccgcggcgaagcagggcagcgccattcctcaggtgcagcaggcgatcgccacgcagcttatcgcggcgtatgacagcctgagcgcgcaggccgcccagctgaccgatttctataatcaaagtgaagaccgtttgctggcgcagggcggcggcaatatcgtgcgggtggacgtcaacaagctgttcgccgaagcgatcgccaatccggcgcagttcggcttcgctaacaccgccggcatggcttgcccgccgggcgtttcctcggcggtctgcagctccgatatgcccggcttcgacgccggccagtcctatctgttctccgaccatttccacccgagcccgcaggcgcacctgctgattgcggattatatccaggcggtgttggatggcccggcgcaggtggtgacgctgaatcaggcgacggcggcgatggcgcgcgacagccgcgccacgctcgacagccgcttccagcagctgcgccacggcgaaaacccgcagggttcgctgggcgtgttcggcggttacgccggccagcactatgactatgccgataaccgggctgcgggggagggcaacgccaccacccacaacctgaccgtcggggtggactatcagctgaccgacggctggctgatcggcgcgttgatcgccggttccaacgacgatcaacatccttccagccgctttgattacaaggcgcgcgggctgctgctgtcggctttcagttcactggcgatattcgagcagggctgggtcaacgccgatttgcactatacgacgatggattatgacgacatccgccgcagcctgcggctggggccgctgacgcgcaccgaaaccggttcgaccaccggcaggcagtggggcgcgcgcgtgaccgccggctatgacttcccgatcgcttcttacctgaccaccgggccggtggcgcagttcgcctgggattacagccgcgtttccggctacagcgaagatggcgatgacagcaccgccatgcgcttcaacgatcaaacctaccactcgcagatcggcgcgttgggctggcggctggatacgcaattcggcgtgtttaacccttatgcggaagtgagttatcagcaccagttcggcgacgacgtctaccgcgccggcggcggcctgaaatcgacgcaaacctcgttcacccgcgacagtgcgggccaggacaaaaactgggtggatgtcacgttgggggccaacatgccgttgacggacagggtatcggccttcgccaccgtctcgcaaaccggcgggctgagcagcggcgagcagtttatgtataacgtaggcgtcagcgcgcgcttttga

SEQ ID NO: 2262 - DNA, 1989 bp, Serratia sp.
atgcctctgaaaaaatcatgcgcgctccgcccggcgatgcttgcagcagcgttggcttttggcttgagtgctacggcacgggcttatgatcaactttatgtgtttggcgacagcctgagcgataccgggaataatggccggttcacttatgacagcaaccagcatcttttgtatgacgaaatattgggtcagcggatcggcgctgcgctgatcgcgtccgacaatggcggttataactatgccgccggcgggggcgtggcggtgcctgctctaaaccctgcggacaatacgcaggatcaggtacaaagctatcttgcccgtgtcgacgatagggccgatggcgaaggattgtatattcactggatcggcggcaacgatctggctgccgccgccatgaaccaggccacggcgccggaggtggcctataccagcgcagcggcggcggctagccaggcacgcgctttactgaatgccggcgccgggacggtaattgtgccaacggtgccgaatattggttcgactccccaactgatggagttgattatccaacaggcgctcggcccggtgcagggagcggctatacaggcggcttacgccaagctcaacgcggtaacgacgccggataatacctcgcgccaggaggcgattcaccaggcgctgagtgctgccgcgcagcaaggcagtatgaatcctctggcgcaacaggcgattgccgcgcaactgatagccgctttcgacagtttcagcgcccaggcgggccagttgaccgatttctataaccagaatgaggatcgcctgctggcgcagggcggcggcaatatcgtgcgtgttgatgtcaacaaactgttcagtgaagcgatcgccaaccctggccagttcggtttcaccaataccgccggcatggcctgcccggttggtgtctcatcggcagtgtgccattcgtcgatgcccggttttaataccgaacagtcttacctgtttgccgatcatttccatcccagcccgcaggctcaccagttgattgccgattatatccaggcggtactcgacggcccggcgcaggcggtagcgctcaatcaggcgacggcggcctttgcgcgtgatagccgcgctactctggacagccgttttcagcagttgcgaaccggcggcaacccgcagggggcgttgggcgtatttggcggttatgccgggcaacgctatgattattcagctaataagatcgctggagatggcgatgctaccacgcataatctaacggtgggcgtagactaccaactgactgatgactggttgatcggcgcgctgttatcgggatccaatgacgatcagcagccgtccagccattatgagtataaggctcgcggcgtgttgttctcggcgttcagcgcgctgacgctgtttgaacaggggtggatcaatgcggatctgcactatgccagcgtgaattacgacgatattcgccgcagcatgcaacttgggtcattgacgcggacggaaaccggcgatacagagggcaaacagtggggggcgcgtgtcacgacgggttacgacttcccgctcacgtcgtacctgaccaccgggccgatggctcaattcgcctgggattacagtaatgtctccggttatagtgagcatggcgatgacagcaccgcgatgcgtttcaacgatcaaacctatcgttcgcaaatcgtggcattggggtggcggttagatactcagcttggtctgtttaacccttatgccgaggtaagctatcagcaccagtttggtgatgacgtctaccgggctggcggcggcttgaagtcgacccaaacctcatttgtcctcgacagcgccggccaggataaagactgggtggatgtcaccctgggggcgaatatgccactgaccgagcgggttgccgcctttgcgacgatttcgcaaaccggcggcttgagtagcggcgaacaatttatgtataacgtaggggtcagcgcacgattctga

SEQ ID NO: 2263 - DNA, 2046 bp, Serratia sp.
atggtcaatgacaaccaggcggctttcttcagtttgcaggctctcaggagtcgattcatgcctctaaaaataatacgcgctgctcaaccggcggcgctggcggtggctttagccttttgtctggctttgccggcaatggcatacgatcgggtttacgtgtttggcgacagtctgagcgacagcggcaacaacgggcgttttacctacgacggcagtcagcatctgctgtatgacgaagcgctggcgcagcgtatcggccaggcgctggtggcgtcggacaacggcggcgacaactatgcggccggtggcggcgtggcggtgccggcgctcaatccggcggacaatacccaggatcagctgcagcgctatttttcccgcgtcaatggccaggccgacggcgacgggctctatattcactggatcggcggcaacgacctggcggctgcggcgctgaacccggcgactgccaccagcgtcagctaccacagcgcggcggcggcggcgatgcaggtgcgatcgctgctggatgccggtgcgggcacggtagttgtgccgacggtgccgaatatcggctctacgccgcagttgatggaactgatcgtgcaacaggcgctggcgccggtacaggcaacggcgttgcaggcggcgtatgccaccctcaatgcgctggctaccccagacgatgccgcgcgtcagcaggcgattcatcaggcgttgagcgcggcggcggcgcaaggtagcaacaacccgcaggtgcagcaggtgattgccgcgcagctgatcgccgcctatgacagtctgcgcgagcaggccggtcaattgaccgatttctacaacagcagcgaagaccgcttactggcgcagggtggcggcaatatcgtgcgcgttgatgtcaataagctgtttggcgaagccatcgccaatccgcagcagttcggcttcaccaacaccgccggcatggcctgtcctgccggcgtgtcgtcagcggtgtgtactggcgcgacgccaggatttgataaccgccagtcgttcctgtttgccgatcatttccacccgagcccgcaggcgcatctgctgatcgccgattacattcaagcggtgctggacggtccggcgcaggtggtggcgctcaaccaggcgacggcggcgatggcgcgtgacagccgtgcaaccctcgacagccgcttgcagcagttgcgcagcggtgataacccgacaggggcgctgggggtgtttggcggctatgccggtcagcattatgactatgccgacaacgcgacggccggcgacggcaacgccaccacgcataacctgacggttggcgtcgattaccaattgaccgacggctggctgattggcgcgctgattgccggttcgaacgacgatcaacagccgtcgagccgctatgaataccaggcgcgtgggctgttgttttccgcctttaccgccttggagctgttcgaacatggctggataaacgccgatctgcactacgcgacgctggactacgatgacattcgccgcagtatgcggctaggggggctgacgcgcagcgaaaccggctccacgtcgggcaaacaatggggtgctcggctgactaccggctacgacctgccgctgacgtcctatctgaccaccgggccgatggcgcagttcgcctgggattacagcaacgtgtccggttacagcgaagacggtaatgacagcaccgccatgcgctttgacgatcaaacctaccattcgcaaattggcgcgctcggctggcggctggacagcaattttggcgccttcaacccgtacgccgaaatcagttatcagcatcagtttggcgataacgtctaccgggccggcggcgggctgaaatcaacccagacatcgtttacccgcgatgccgccggacaggataaaaactgggtcgatgtcaccgtcggtgccaacctgccgttgggcgatcgggtggcggcgttcgctaccgtttcgcaaaccggtggtctgagcagcggcgagcagtttatgtataacgtcggcgtcagcgcgcggttttga

SEQ ID NO: 2264 - DNA, 1989 bp, Serratia sp.
atgcctctaaaaataatgggcgctcccggcagggcagcgctggcggtggctttagttctcgggctggcggcgtccgccgcggccgccgagcgggtgtacgtgttcggcgacagcctgagcgacagcggcaacaacgggcgctacacctacgacggcagccagcatccgctgtatgacgaagcgctggcgcagcgtatcggcgcggcgctgctggcgtccgatctcggcggcgacaactatgcggccggcggcgcggtggcggtgccggcgctgaatccggcggacaatactcaggatcaggtacagcgctatctgagccagacccacggccgcgccgacgccaatggcctgtatatccactggatcggcggcaacgatctggcggcggcggcgttaaatccggccagcgcgccgcaggtcagctataccagcgccgccgcggcggcgctgcaggtgcggtcgctgctggatgccggcgccggcacggtgatcgtgccgacggtgccgaacatcggctttaccccgcagctgatggaagtgattgtgcagcaggcgctggcgccggtgcagaacgcggcgctgcaggcggcctatgcggcgctgaatgcggtggcgacgccggacgccgcttcgcggcagcaggcgattcaccgggcgctgagcgcggcggcgcagcagggcagcagcgacccgcagatgcagcaggcgatcgccgcgcagctgatcgccgcctatgacagcctgagcgcgcaggcgggccagctgaccgacttctacaaccgcagcgaggaccagctgctggcgcagggcggcggcaacatcgtgcgcgccgacgtcaaccggctgtttggcgaggtgatcgccaatccgcagcagttcggcttcagcaataccgccggcatggcgtgtccggccggcgtatcgtcggcggtatgccgctccgcgacgcccggctttaacgacggccaggccttcctgttcgccgaccatttccaccccagcccgcaggcgcatctgctgatcgccgattacattcaggcggtgctggacggcccggcgcaggcggcggcgctgacgcaggcgacggcggcgatggcgcgcgacagccgcgccaccctcgacagccgttttcagcagctgcgcagcggcggcaacccgcagggagcgctgggaatattcggcggctatgccgggcagcattatgactatgccgacaataaagcggccggcgacggcaacgccaccacccacaacctgacgctgggggtggattaccagctgacggaccgctggctgatcggcgcgctgatctccggcgccaatgacgatcagcagccctccagccgctatgactaccaggcgcgcggcgtgctgttttccgcctttacctcgctggacgtgtttgagcacggctgggtgaacgccgatctgcactacgccaggctggattacgacgatattcgccgcagcgtgcagcttggcccgctgacgcgcagcgaaaccggctcgacctccggcaaacagtggggcgcgcgcgtcaccgccggctatgacttcccgctgacctcaagtctgagcaccgggccgatggcgcagtttgcctgggactacagcaacgtttccggctatagcgaagacggcaacgacagcaccgccatgcgctttaacgaccagacctaccattcgcagatcggcgcgctgggctggcggctggacagcaacctcggcgtgattaacccgtatgccgagatcagctatcagcatcagttcggcgacgaggtgtaccgcgccggcggcggcctgaagtcgacctcaacctcgtttacccgcgatgccgccggccaggataaaaactgggtcgacgtcacgctgggggccaatctgccgctgaacgaccgggtggcggcgttcgccaccgtctcgcagaccggcggcctgagcagcggcgaacaggtgatgtacaacgtcggcgtcagcgcccgcttttaa

SEQ ID NO: 2265 - DNA, 2004 bp, Yersinia sp.
atgcctatcaaaataatgtatccgtatcgcatggatgcactggccattgctttatttttttgcgccactggccctacattcgcttacgacaatgtttatgttttcggcgacagtctgagtgataccggaaataacggcagattcacctacgatagcaaccagcattatttatacgacgagattttggcgaaaaatgcaggtatgacattagtcgcgtcggataaaggcgggtttaactacgccgctggcggcgccgttgcggtgccagcactcaaccccgcctacaatacgcagaatcaagtacaaagttacttgcagcgagtgaacggtcaggccgacagtaacggcctgtatctgcattgggtaggcggtaacgatttggccgctgcggcggcctcaaacccggccagcgcacccagcgtggcgtataacagcgctgccgctgccgcaacgcaggtacaggctttactcaatgccggagccaatacggttatcgttccgaccgtgcccaatatcggcgctaccccaatgttaatggaactggttattcaacagggattggctgccgtacagccttcagcaatacccggcgctctacaggccgctttcagcacgctaaatgccctgactacgcctgataacccctcccgcagacaggctattcatcaggcactcaccgccgcctctgaacgaatcagctctattccgcaagtacagcaagggattgccgttcagctcatagctgcctttgatgatcaaagcgctctggccgggcaactcacagatttttataataatagtgaggacgctttgctcgcccaaggtagcggcaatattgtccgcgtcgatgtgaataaactattcggtgaaattattagtaatccgaatctgttcgggtttaccaatacggcagtaatgccctgcccgataggcgtttcttcagcggtttgtacttcgggtcaggctggctttgccccgggccaatcctaccttttctccgatcattttcacccaagcccgcaggcgcatcagatgatagccgattatatgcaagcggtacttgatgcccccgcgcaagccgctgcgctgacacaagccacggcggcgatggctcgcgacactcgagctaccctggacagccgtttccagcaattgcgcactcataaaaatccgcaggactcatttggcgtatttggcggttatgccgggcagcattatgattattcagccaacattgccgccggagatggcaatgccactactcataatctgaccttgggtatagattatcagttgaccgaaaattggctgattggcgcattaattgcgggatcgaatgataatcaacggccttccagccgttacgattataaggcgcgtggtttgctgctttcagccttcagcgctctggaattcgcggattatgcctggatgaatgccgacgtacactacgccagcatgaattacgatgatatacgtcgcagtatgcagatcggcacattaacccgaactgaaaccggtaataccgatggcaaacagtggggagccagattcactaccggatataatattccgatcaccacttacctgaccactggcccgatggcgcaatttgcgctggattacagcaatgtgtcgggatatagcgaaaatggtaacgacagtacggccatgcgcttcagcgatcaaacttatcattcgcaaattggatctttgggctggcggctggatggcaaattttccttatttaacccttatgccgaagtgaattaccaacatcagtttggggatgacgtttatcgaagcggtgggggcctgaaatcaactcaaactcattttgtccgcgacagcgccagacaggataagaactgggtgaatctcactcttggtgccaacgtgccgctcacggataacgtggcctcgtttgcctccatatcgcagaccaccggcctgagcagcggcgagcaatttatgtataacattgggttaagcgcccgtttttaa

SEQ ID NO: 2266 - DNA, 1962 bp, Yersinia sp.
atggctgcactcgctgccactttatcgttctgtatcaccccttcgtcattcgcgtatggccaactttatgtatttggcgatagtctgagcgataccggtaataatggaaaattcacctacgatagcagtacccaccttctgtatgacgaagtgttagcacaacatataggcgccaacctgatcccatccaatatcggcggcttcaattatgctactagtggtgccgtagctactccggcactgaatgccactaacaacactcaagatcaagtgcaaaattatctgaaccaagtcaatggtaaagcagatagcaacggcctgtatatccactggatcggcggtaatgatctcgctgcagctgcaacattaaacccagccgcgtcacaaacagtggcttataccagtgctgcggctgccgctatgcaggtacattcattgctaaacgcgggtgctggcacggtgatagtgccgacggtccccaatatcggttctacgccaatgttaatggagttagttatccagcaaggattgacctctgtgcaaaatgccgcagtgcaagcggcctatgccacgctaaattcccttgccactccagacaataccagccatcagcaggctattcatcaggcacttaccgctgctgctgggcaagcaagcattatcccaccagtccagcaagcgatcgcagctcagcttatcgacgcctacgacaaattaagcacacaggccgagcaacttaccaactttttcaatagcagcgaagatcacctgttagcacaaagtggtggcaatattgtaagagttgatgtgaacaaattatttgccgaagttatcgccaacccacgccaatttggttttaccaatacggtagggatgccctgcccaccgggtgtatcgtcagcagtttgtagcgctacgcaaaccggttttgatcacagccaatcgtatctgtttgccgataattttcacccaagtccacaagcccatttgctggttgccgattatatgcaggcagtacttgatgggccaacacaagctgtcgccctgacccaagctacggcagcaatagcccgagacagccgcgccacgcttgatagccgcttccaacaattacgcatcggcaaaaatccgcagaataccctaggaatctttggcggttatgctgggcagcattacgactattcagccaatttgacagctggaaatggcaatgccaccacacataatctgagtgtgggtgttgactatcaactgactagtcgctggcttattggagcgctgatatcgggttcgaatgacaatcaacaaccttccacccgctatgattacaaagcacgaggtctcttgttctcagcatttaccgccttgaatatagttgaccacggctggataaatgctgatttacactacgcaactatgaattacgatgacatccaacgcagtatgcaactagggccaatgacccgtactgagaacggtaataccgatggtaaacaatggggagcaagactgaccgtaggttatgacattccgatcactccctatctgacaaccgggccgataacacaattctctctcgactacagtaatgtgtcgggttacagcgagcaaggtagcagcagcactgcaatgcatttcaacgatcaaacctaccattcacagattggtgcactcggctggcgattggatggacaatttagccaattcgccccttacgccgaagtgctctatcagcaccaatttggtgatgatgtctaccgagcaggtggcgggttgaaatctactcaaacccaatttgtgcgtaacaccgccaaacaggataacaactggctggatattactctcggagccagcctaccattgaccgaccgattaactgcatttgcctccatctctcaaaccggtaatctgagcagtggcgaacagcttcgatataacatcggtgtcagtgcccttttctag

SEQ ID NO: 2267 - DNA, 1992 bp, Yersinia sp.
atgtcttcaaaaacatcgtatgcagcacgaatggctacactcgccgccactttatcgttttgtgtcattcctttgtcattcgcatatgaccaactttatgtatttggcgatagtctgagtgataccggtaataatggtaaattcacctacgatagcagtacccaccttctgtatgacgaagtgttagcacaacatatcggtaccaacttgctcccatccagtcatggtggcttcaattatgcgaccagtggcgctgtagcaaatccggcactgaatgccactcacaacacccaagatcaagtgcaaaattatttgaatcgggtaaacggcaaggcggatagcaacggtctgtatatccattggatcggtggtaatgatctcgccgcggctgcaacactcaatcccgccgcgtcacagacagtggcttataccagtgcggtggctgccgccatgcaggtaaattcattactaaacgcgggtgctggcacggtgatagtgccgacggtacctaacatcggttctacgccaatgctaatggagctagttatccagcaagggctgagcgcagtgcaaaatgctgcagtgcaagcggcctataccacacaaaactcgctagccacacccgataataccagccatcagcaagcgatccatcaggcacttaccgctgccgccgagcaggcaagcattgtcccatcagtccaacatgcgatcgccgctcagcttatcgatgcctacgacaaattaagcacgcaggcagaaaagcttaccgagttcttcaatagcagcgaagaccaccagttagcacaaaatgggggcaatatcgtcagagctgatgtgaaccgattatttgccgaagttatcgccaatccacgtcagttcggctttaccaatacggtagggatgccctgcccgccaggcgtatcgtcagcagtttgtagcgccacgcaagtcggttttaatgacagtcagtcgtatctgtttgccgataattttcacccaagtccgcaagcccatttgctcgtagccgattatatgcaggcggtgcttgacgggccaacacaagttgtcgcgctgacccaagctacggcagcaattgcccgagacacccgcgccacactcgatagccgtttccaacaattgcgtaccggtaaaaatccaccgaatgccttggggatttttggcggttatgctgggcagcgttacgactattcggccaatttgaccgccggaaatggtcatgccactacacataatttgagtgtaggcgttgactatcaactgactaaccgctggcttattggagcattgatttcaggttcgaatgacaatcaaaaaccttccacccgctatgattatagcgcacgtggtttcttgttctccgcatttaccgccttggatatacttgatcacggctgggtaaatgccgatttgcactacgcaaccatgaattacgatgatatccaacgcagtatgcaactcgggccactgacccgtactgaaaacggtgatacccatggtaaacaatggggagccaggttgaccgcaggttatgacatcccgatcactccctatctgacaaccggcccgataacacaattttctctggactacagtaatgtgtctggctatagcgagcaaagtaacagtagcactgcgatgcatttcaacgatcaaacctatcattcacagattggtgcaatcggctggcgattgagtggacaattcagccatttctctccttacgccgaagtgctctatcagcaccagtttggtgatgatgtctaccgagcaggtggcgggttgaaatcgactcaaacccaatttgtgcgtaacaccgccaaacaagataacaactggctggatatgactctcggagccagcctaccattgaccgaccaattaaccgcatttgcctctatatctcaaaccggcaatctgagtagtggtgaacaatttcgctataacatcggtttcagcgccctcttctag

SEQ ID NO: 2268 - DNA, 1113 bp, Serratia sp.
atgtctgcaacgctgaaacgcctgacgttcggcatgctgctgctgtgtgcattcggcgcggcggcggcctgcgagtggccagcctggcaacagtacaaacagttttacatcagcgacgaaggacgggtgatcgacccgagcagcccgaaccgtatcaccacctcggaggggcagagctacggcctgttcttcgccctggtggcgaacgatcggccgacgttcgacaagctgctggagtggacggaaaacaacctggcggcgggcgatctcagcgcccatttgcccgcctggctgtggggcgaggatgataaaaagcgttggacggtgctggacacgaatacggcgtccgatgccgatctgtggattgcctacaatctgctggaagccggtcgtttgtggaaaagccggcgttatcaaaccctgggtacgctgctgttgcagcgtatcggccgcgaagaagtggccgatatccccgggctggggttgatgctgctgccgggcaaggtcgggttcgtggcgcaagatcgctggcggctcaatccgagctacctgccgccgcagctgctggcgcgttttgccgccctgaacggcccatggcgagcgatgcagaaaaccaatcagcggttgttgctggaaaccgcaccgcacggcttctccccggattgggtggtgtggcaggccggcaaaggctggcaaccggataccgtgaaaccggatgtcggcagttacgacgccatccgggtttatctgtggatcggtatgttggcggacgatgacgagcataaagccgcattggtcaaacagctgctgccgatggcgcaatcgaccgctcaacagggtgtaccgccggaaaaaaccgacaccgccagcggcaaaaccagcggcgacggcccggtgggtttctccgcggtcatgctgccgatgctggccaatcaaacggctgcgctggacgtccagcgccaacgcatcaatcaacaccctccgggcgacgatgcctatttcagcgcctctttgacgctgttcggccagggatgggatcaacaacgttatcgttttaatcggcagggtgaacttcaacccgcctggggcggccaatgcgtaacttcaaaataa

SEQ ID NO: 2269 - DNA, 1080 bp, Serratia sp.
atgctgctgctgtgtgcattcggcgcggcggcggcctgcgagtggccggcctggcaacagtacaaacagttttacatcagcgacgaaggacgggtgatcgacccgagcagcccgaaccgcatcaccacctcggaggggcagagctacggcctgttcttcgccctggtggcgaacgatcggccgacgttcgacaagctgctggagtggacggaaaacaacctggcggcgggcgatctcagcgcccatttgcccgcctggctgtggggcgaggacgataaaaaacgctggacggtgctggacacgaatacggcgtccgatgccgatctgtggattgcctacaatctgctggaagccggtcgtttgtggaaaagccggcgttatcaaactctggggacgctgctgttgcagcgtatcggccgcgaagaagtggccgacatccccgggctggggctgatgttgctgccgggcaagatcgggttcgtggcgcaagatcgctggcggctcaatccaagctacctgccgccgcagctgctggcgcgttttgccgccctgaacggcccatggcgagcgatgcagaaaaccaatcagcggttgttgctggaaaccgcaccgcacggtttctccccggattgggtggtgtggcaggccggcaaaggctggcaaccggataccgtgaaaccggatgtcggcagttacgacgccatccgggtttatttgtgggtcggtatgttggcggacgatgacgagcataaagccgcattggtcaaacagctgctgccgatggcgcaattgaccgctcaacagggtgtaccgccggaaaaaaccgacaccgccagcggcaaaaccagcggcgacggcccggtgggtttctccgcggtcatgctgccgatgctggccaatcaaacggctgcgctggacgtccagcgccaacgcatcaatcaacaccctccgggcgacgatgcctatttcagcgcctctttgacgctgttcggccagggatgggatcaacaacgttatcgttttaatcggcagggtgaacttcaacccgcctggggcggccaatgcgtaacttcaaaataa

SEQ ID NO: 2270 - DNA, 1113 bp, Serratia sp.
atgttcgcaacgctgaaacgcctgacgttcggcatgctgctgctgtgcgcattcagcgcggcggcggcctgcgagtggccggcctggcaacagtacaaacagttttacatcagcgaggaaggacgggtgatcgaccccagcagcccgaaccgcatcaccacctcggaagggcagagctacggcctgtttttcgctctggtggcgaacgatcggccgacgttcgacaagctgctggaatggacggaaaacaacctggcggcgggcgatctcagcgcccatttacccgcctggctgtggggcgaggacgataaaaagcgctggacggtgctggacacgaatacggcgtccgatgccgatctgtggattgcctacaatctgctggaagccagtcgtttgtggaaaagcaggcgttatcaaactctgggtacgctgctattgcagcgtatcggtcgcgaagaagtggccgatattcccggactggggctgatgctgctgccgggcaaggtcgggttcgtggcggaagatcgctggcggctcaatccgagctacctgccgccgcagctgctggcgcgtttcgccgcattgaacggcccatggcgagcgatgcagcaaaccaatcagcggctgttgctggaaaccgcgccgcacggcttttcgccggattgggcggtgtggcaggccggcaaaggctggcaagcggataccgtgaaaccggatgtcggcagttacgacgccatccgggtttatctgtgggccggcatgctggcggatgatgacgagcataaagccgcattgatcaaacagctgctgccgatggcgcaattgaccgctcaacagggcgttccgccggaaaaagccgacaccgccagcggtaaaaccagcggcgatggcccggtgggcttctccgccgccatgctgccgatgttggccaaccaaacggctgcgctggacgcccagcgtcaacgcatcaatcaacaccctccgggcgacgatgcctatttcagcgcctctttgacgctgttcggccagggatgggatcaacaacgttatcgttttaatcggcagggtgaacttcaacccgcctggggcggccaatgcgtaacttcaaaataa

SEQ ID NO: 2271 - DNA, 1113 bp, Serratia sp.
atgccagtggcgttgaaacgtctgacattcggcatgctgctgctgtgcgccttcagcgcagcggcggcctgcgaatggccggcctggcaacagtacaaacaattttatatcagcgaacagggacgcgtgatcgatccgagcagcccgaaccgcattaccacatcggaagggcagagttatggcatgttcttcgcgctggtagcaaacgatcgaccagcgtttgaccagctgctggagtggacggaaaacaatttggctgcgggcgatcttagcgcccatttacctgcgtggctgtggggtgagaacgataaaaaacagtggacggtactggacagcaattctgcatccgacgcggatttgtggattgcctacaatctgctggaagcggggcgcttatggaacagtcgccgctatcaaacccttggcacgttgttgttgcagcgaattgcccgtgaagaggtggcggatattcccggtctgggtttgatgctgttgccgggaaaggtggggtttgtggctgaagaccgttggcgactcaatccgagctaccttcccccccaattgctggcacgtttttctgccttaaatggtccgtggcgggcaatggagcaaaccaatttgcgattgtggctggaaaccgcaccacacggcttctcaccggactgggtggtgtggcaggtcggcaaaggctggcaaccggataccgtcaaaccgaacatcggcagttatgacgctatccgggtttatctgtgggccggcatgctggcagatgacgataaacaaaaggcagcattactcaagcaattgcagccgatggcgcaaactaccctgacacagggtgtcccaccggagaaaacggatacagccagtggcaaaaccagtggcgacggtccggtgggcttctctgcttccatgttgccgatgctggtgaaccaaccagaggcgttgcaggtacagcgccaacggattaagcaaaacccgccgggtgataatgcctatttcagtgcctcgttggtgctgttcggtcagggatgggatcaacaacgttatcgttttaatcggcagggtgaacttcaaccctcctggggcggccaatgcgtaacttcagaataa

SEQ ID NO: 2272 - DNA, 1113 bp, Serratia sp.
gtgaacgcgatgctgcaacgcctgtcgctcggcatgctgctgctgtgcgccttcagcgccgccgcggcctgcgagtggccgggttggcaacagtacaagcaattctacatcagcccgcaggggcgggtgatcgacccaagcagcccgaacaaaatcaccacctccgagggacagagttacggcctgtttttcgccctggtggccaacgaccggccgaccttcgacctgttgttgacctggacggagaacaatctggcggcgggcgatctcagcgcccgcttgcccgcctggctgtggggagagagcgacgataagcagtggaaggtgctggacgccaactcggcgtcggacgccgacctgtggattgcttacaacctgctcgaagccggccgcctgtggaaaagccggcgttatcaaaccctgggaacgctgctgctgcaacgcatcggccgcgaggaagtggccgacattcccggcttgggcctgatgctgctgccgggcaaagtcgggttcgtggcggaagatcgctggcggctgaatcccagctacctgccgccgcagctgttggcgcgttttgcggcgctgaacggcccatggcgtgcgatgcgcgagatcaatcagcgactgtggctggacactgcgccgcacggcttctcgccggattgggtggtgtggcgggtcggcgccggttggcagccggacaccgtcaagccaaacgtcggcagctacgacgccattcgggtttatctgtgggccggcatgctggcggacgacgatgaacacaaggcggcgctgcttgaacgcttccagccgatggcgcagctcactgccaaacagggcgttccgccggagaaaaccgataccgccagcggcaaaactaccggcgacggcccggtcggtttctccgcttctatgctgccgatgctggcgacgcaggctgaagcgctggcggtgcagcggcagcgcatcagcgagcatccgccgggtgatgacgcctatttcagcgcctcgctgaccctgttcggtcagggatgggatcaacaacgttatcgctttaatcgtcagggtgaattgcaaccctcgtgggacggccaatgcacaacttcaaaataa

SEQ ID NO: 2273 - DNA, 1122 bp, Serratia sp.
ttgacggcggtgaacgcgatgctgcaacgcctgtcgctcggcatgctgctgctgtgcgctttcagcgcggcggcggcctgcgaatggccgggctggcaacagtacaagcagttctacatcagcccgcaggggcgggtgatcgatccgagcagcccgaacaaaatcaccacgtcggaggggcagagttacggcctgttcttcgccctggtggccaatgaccggccgaccttcgaccagctgttgacctggacggagaacaacctggcggcgggcgatctcagcgcccgtttacccgcctggctgtggggcgagggcgacgacaagcagtggaaggtgctggacgccaactcggcgtcggacgccgatctgtggattgcttataacttgctcgaagccggccgcctgtggaaaagccggcgttatcaaaccctggggacgctgctgttgcagcgcatcggccgcgaggaagtggccgacatccccggcctggggctgatgctgctgccgggcaaagtcgggttcgtggcggaagatcgctggcggctgaaccccagctacctgccgccgcagctgttgacgcgttttgcggcgctgaacggcccgtggcgcgcgatgcgcgagatcaatcagcggctgtggttggagaccgcgccgcacggcttctcgccggactgggtggtatggcgggtcggtgccggctggcagccggacaccgtcaagccgaacgtcggcagctacgacgccattcgggtctatctgtgggccggcatgctggcggacgacgatgaacacaaggcggcgctgctcaaacgcttccagccgatggcgcagctcaccgccagccagggcgtgccgccggagaaaaccgataccgccagcggcaaaaccaccggcgacggcccggtcggcttttccgccgcgatgttgccgatgttggcggcgcaggccgacgcgctggcggcccagcggcaacggatcggcgaacacccgccgggtgacgacgcctatttcagcgcctcgctgacgctgttcggccaggggtgggatcaacaacgttatcgctttaatcgtcagggtgaattgcaaccctcgtgggacggccaatgcacaacttcaaaataa

SEQ ID NO: 2274 - DNA, 1122 bp, Serratia sp.
ttgacggcggtgaacgcgatgctgcaacgcctgtcgctcggcatgctgctgctgtgcgctttcagcgcggcggcggcctgcgaatggcctggctggcaacagtacaagcagttctacatcagcccgcaggggcgggtgatcgatccgagcagcccgaacaaaatcaccacctctgaggggcagagttacggcctgtttttcgccctggtggccaacgaccggccggccttcgacctgttgttgacctggacggagaacaatctggcggcgggcgatctcggcgcccgtttgcccgcctggctgtggggcgagagcgacgataagcagtggaaggtgctggacgccaactcggcgtcggacgccgatctgtggatcgcctacaacctgctcgaagccggccgcctgtggaaaagccggcgttatcaaaccctggggacgctgctgctgcaacgcatcggccgcgaggaagtggccgacattcccggcctgggcctgatgctgctaccgggcaaagtcgggttcgtggcggaagatcgctggcggctgaatcccagctacctgccgccgcagctgttggcgcgttttgcggcgctgaacggcccatggcgcgcgatgcgcgaggtcaatcaacggctgtggctggacaccgcgccgcacggcttctcgccggattgggtggtgtggcgggtcggtgccggttggcagccggacaccgtcaagccgaacgtcggcagctacgacgccattcgggtttatctgtgggccggcatgctggcggacgacgatgaacacaaggcggcactgcttgaacgattccagccgatggcgcagttcactgccaaacagggcgttccgccggagaaaaccgataccgccagcggcaaaaccaccggcgacggcccggtcggtttctccgcttctgtgctgccgatgctggcgacgcaggctgaagcgctggcggtgcagcggcagcgcatcagcgagcacccgccgggtgacgacgcctatttcagcgcttcgctgacgctgttcggtcaggggtgggatcaacaacgttatcgctttaatcgtcagggtgaattgcaaccctcgtgggacggccaatgcacaacttcaaaataa

SEQ ID NO: 2275 - DNA, 1104 bp, Serratia sp.
atgctgcaacgcctgtcgctcggcatgctgctgctgtgcgccttcagcacggcggcggcctgcgagtggccgggctggcaacagtacaagcagttctacatcagcccgcaggggcgggtgatcgatccgagcagcccgaacaaaatcaccacctccgaggggcagagctacggcctgttcttcgccctggtggccaatgaccggccgaccttcgatctgctgttgacctggacggagaacaacctggcggcgggcgatctcagcgcccgtttgcccgcctggctgtggggcgagagcgacgacaaacagtggaaggtgctggacgccaactcggcgtcggacgccgatctgtggatcgcctacaacctgctcgaagccggccgcctgtggaaaagccggcgctatcaaaccctggggacgctgctgttgcaacgcatcggccgcgaggaggtggccgacattcccggcctgggcctgatgctgctgccgggcaaagtcgggttcgtgacggacgatcgctggcggctgaaccccagctacctgccgccgcagctgttggcgcgttttgcggcgctgaacggcccgtggcgcgcgatgcgccaggtcaatcaacggctgtggctggacaccgcgccgcacggtttctcgccggactgggtggtgtggcgggtcggcgccggctggcagccggatcccgtcaagccgaacgtcggcagctacgacgccattcgggtttatctgtgggccggcatgctggcggacgacgatgaatacaaggcggcgctgctcgaacgttttcagccgatggcgcagctcaccaccaaacagggcgtgccgccggagaaaaccgataccgccagcggcaaaaccaccggcggcggcccggtcggcttttccgcctcgatgctgccgatgttggcgacgcaggctgaggcgctggcgacacagcggcaacgcatcagcgaacatccgccgggggacgacgcctatttcagcgcctcgctgacgctgttcggtcaggggtgggatcaacaacgttatcgctttaatcgtcagggtgaattgcaaccctcgtgggacggccaatgcacaacttcaaaataa

SEQ ID NO: 2276 - DNA, 1116 bp, Serratia sp.
atgatggggatttgcctgcgccgcctgctgcctggtctgatgctgctttgtgcgttcagcacggcggcaagctgtgattggcctgcctggcagcagtaccaacggttttatcttagcgaggaagggcgggtaatcgatcccagcagcccgaagcgcattaccacgtccgaagggcagagctatggcatgttcttcgcgctggtggccaacgatcggcctgccttcgataagctgttggcgtggacggagaacaatctcgcctctggtgacctgagcgcacatctgccggcttggttgtgggggcaggatgataacaaggcctggaaggtgctggacagcaactcggctgccgatgcggatctgtggattgcgtataacctgctggaggcggggcggctgtggcaaagccgccgctatcaaacattgggcacgctgttgttgcaacggattggccgtgaagaggtggcgaatatccccggtttggggctgatgctgctgccggggaagatgggttttgtggccgaggaccgctggcgcttgaaccctagctatttaccgccgcagctgctggcccgttttgcccaattgaacgggccgtggcgagcgatgcagaaaaccagccagcggttgctgttggaaacggctccgcaaggattttcaccagactgggccgagtggcaagcgggcaaaggctggcagcccgatcccgtcaaacctgatgtcggcagctatgacgccatccgcgtttatctctgggccgggatgttggcggacgacgatccccataaagcggcgctgatgaagcagttccaaccgatggtacgccttaccgcccagcttggtgcagtgccggagacggtcgatacagctagcggaaaagccaacggtactggcccggtaggcttctccgccgcgatgttgccgttattggccgcacagcctgatgccctggcggtgcaacgccaacgtattcaggataaccctctgggtaatgatgcctatttcagcgcctctttgctgttgttcggccagggatgggatcagcaacgctatcgtttcaatcgtcagggtgaacttcaacccgcctggagtagccaatgcgcaacttcacactag

SEQ ID NO: 2277 - DNA, 1116 bp, Serratia sp.
atgatgaggaactgcctgcgccgcctgctgcctggcctgatgctgctgtgtgcgttcagcacggcggcaagctgtgattggcctgcctggcagcagtatcaacagttttatctcagcgaggaagggcgggtgatcgatcccagcagcccgaagcgcattaccacgtccgaagggcagagctatggcatgttcttcgcgctggtggccaacgatcggcctgctttcgataagctgttggcgtggacggagaacaatctcgcctctggtgacctgagcgcacatctgccggcctggttgtgggggcaggatgataacaaggcctggaaggtgctggacagcaactcggctgccgatgcggatctgtggattgcgtataacctgctggaggcggggcggctgtggcaaagccgccgctatcaaacattgggcacgctgttgttgcaacggattggccgtgaagaggtggcgaatatccccgctttggggctgatgctgctgccgggcaagatgggttttgtggccgaggatcgctggcgcttgaaccccagctatttaccgccgcagttgctggcccgctttgcccaattgaacgggccgtggcgagcgatgcagaaaaccagccagcggttgctgctggaaacggctccgcaaggattttcacccgactgggccgagtggcaaacgggcaagggctggcagcccgatcccgtcaaacctgatgtcggcagctatgacgccatccgcgtttatctctgggccgggatgttggcggacgacgatccccataaagcggcgctgatgaagcagttccaaccgatggtacgccttaccgcccagcttggtgcagtgccggagacggtcgatacagctagcggaaaagctaacggtactggcccggtaggcttctccgccgcgatgttgccattattggccgcacagcctgatgccctggcggtgcaacgccaacgtattcaggataaccctctgggtaatgatgcctatttcagcgcctctttgctgttgttcggccagggatgggatcagcaacgttatcgcttcaatcgtcagggtgaacttcaacccgcctggagtagccaatgcgcaacttcacactag

SEQ ID NO: 2278 - DNA, 1110 bp, Serratia sp.
gtgggcgtgctgttgaaatactccctgagcctgctgctgctgtgcgcgttcggcgcggcggccggctgcgactggccggcctggcagcgctataagcaggactacatcagcgcgggcggccgggtgatcgacccgagcacgcccaaccgcatcaccacctcggaagggcagagctacggcctgttcttcgcgctggtggccggcgatcgtccggcctttgaccgactgctgagctggaccgaagacaatctggcgcagggcgatctcagcgcccgcctgccggcctggctgtggggggaaaatgagaacaagcagtggacggtgctggatgataattcggcgtccgattccgatctgtggatcgcctacagcctgctggaagccggccgcctgtgggacagccgccgctaccaaacgctgggcaccctgctgctacagcgcattgcgcgcgaagaagtggcggatatccccgggctggggccgatgctgctgcccggcaaggtcggctttgtgaaggacgacggctggcggctcaacccgagctacctgccgccgcagctgctggcgcgctttgccgcgctgcgcgggccgtggcgggcgatgcagcagtcgaatcagcggctgtggctggagaccgcgccgcacggcttctcgccggactgggtggtatggcgcaagacgcagggatggcgggccgacgcggccaagccgaacgtcggcagctatgacgccatccgcgtctatctgtgggcgggcatgctggcggatgacgatgcgcacaaagctgcgctggtgcggcgtttccagccgatggcgcagctgaccgcgcagcagggcgtgccgccggaaaaaaccgataccgccagcggtaaaaccagcggcaacggcccggtgggcttttccgccgccctgctgccgctgctggcgcaccagcctgaggcgctggcggcgcagcgacagaaaattatcgaccacccgccgggcaacgacgcctacttcagcgcgtcgctgacgctgttcggccagggctgggatgaacaacgttaccgttttaaccgtcagggtgaactgcaaccttcctgggatcgccaatgcgcaacttcagaataa

SEQ ID NO: 2279 - DNA, 1110 bp, Serratia sp.
gtgggcgtactgttgaaatactccctgagcctgctgctgctgtgcgcgttcggcgcggcggccggctgcgactggccggcctggcagcgctataagcaggactatatcagcgcgggcggccgggtgatcgacccgagcacgcccaaccgcatcaccacctcggaagggcagagctacggcctgttcttcgcgctggtggccggcgatcgtccggcctttgaccgcctgctgagctggaccgaagacaatctggcgcagggcgatctcagcgcccggctgccggcctggctgtggggggagaatgagaacaagcagtggacggtgctggatgacaattcggcgtccgattccgatctgtggatcgcctacagcctgctggaagccggccgcctgtgggacagccgccgctaccagacgctgggcaccctgctgcttgcgcgcattgcgcgcgaagaagtggcggatatccccgggctggggccgatgctgctgcccggcaaggtcggctttgtgaaggacgacggctggcggctcaacccgagctacctgccgccgcagctgctggcgcgctttgccgcgctgcgcgggccgtggcaggcgatgcagcagtcgaatcagcggctgtggctggagaccgcgccgcacggcttctcgccggactgggtggtatggcgcaagacgcagggctggcgggccgacgcggccaagccgaacgtcggcagctatgacgccatccgcgtctatctgtgggcgggcatgctggcggatgacgatacgctcaaagccgcgctggtgcggcgtttccagccgatggcgcagctgaccgcgcagcagggcgtgccgccggaaaaaaccgataccgccagcggtaaaaccagcggcaacggcccggtgggtttttccgccgccctgctgccgctgctggcgcaccagcctgaggcgctggcggcgcagcgacagaaaattatcgaccacccgccgggcaacgacgcctacttcagcgcgtcgctgacgctgttcggccagggctgggatgaacaacgttaccgttttaaccgtcagggtgaactgcaaccttcctgggatcgccaatgcgcaacttcagaataa

SEQ ID NO: 2280 - DNA, 1092 bp, Serratia sp.
atggaccttgaccctgctgctgctgtgcgcgttcagcgccacggcggcctgcccgtggccggcatggcagcagtaccggcagttttacatcagcgaggggggcgggtgatcgaccccagcagcccgaaccgtattaccacctcggaggggcaaagctacgggctgtttttcgcgttggttgccaacgatcggccgaccttcgatcggctgctgaactggaccgaaaacaatctggcgaagggcgatctcggcgcccaccttcccgcctggctatggggggaggatgataagcagcgctggctggtgctggatgacaattccgcctctgacgccgatctgtggatcgcctacagtctgctggaagcgggccggttatggcaaagccggcgttacctcacgttgggcaccctgctattgcaacgcatcgcgcgtgaagaagtggcggatattcccggcctggggccaatgctgttgccgggcaaaatgggctttgtcgacgaccctcgctggcggctcaatccgagctatctgccaccgcaactgctggcgcgctttgcctcgctgaacgggccatggcaggcgatgcagcaggttaatcagcgtatgttgctggaaactgcgccgcacggtttttcccccgactgggtggtgtggcagcgtgacaagggttggcaagcggacggcgcgaaaccgaacatcggcagctacgacgccatccgcgtctatctgtgggccggcatgctggcgagcggcgatccgctccgtaccgcgttgcgggagcgttttttgccgatgacgcagctgaccgcacggcagggcgtgccgccggaaaaaaccgataccgccgccggaaccacccgtggtgacggtccggtggggtttgccgccgcgctattgccgctgctggccgatcaacccgatgcgttggcgcggcaacgccagcgtgtcaacgacaacccgccaggcgacgacgcctatttcagcgcttcgctgacgttgttcggccagggatgggatcagcaacgttatcgttttactcgtcagggtgaacttcaacccgcctggggcagccaatgcacaacttcagaataa

SEQ ID NO: 2281 - DNA, 1119 bp, Serratia sp.
atggccatgacgggaggttgcctgcaacgtctgctgtatggtgtattgctgctgtgtgccgtcaacacggcaaccgcctgtgaatggccggcctggcagcaataccggcagttttacatcagcgatgatgggcgggtgattgatcccagtagcccaaatctggtaactacctcagaagggcaaagctacgccatgttctttgctctggtggctaatgatcgggcaacgttcgataaactgctgaaatggacggaaaacaacctgtctgctggctccctgacggcccatctgcctgcctggttgtgggggaagaacgatcaaaatcattggcaggtgttggacagtaattctgcgtcggatgctgatttgtggctggcttatgacctgttggaggccgggcgcttgtggaaaaaccatcattaccaacgtgtgggcagattgctgttgcaacggattggtcgtgaagaggtcgtagatattcccgatttagggaagatgctgttaccgggcaaggtgggctttgtggctgaagaacgttggcggctcaatcccagttatttaccgccacaactcctggcacgttttgctcgctttaatgggccctggaaagcgatgaagaaaagtaaccagcgcttgttgttggagaccgcgccacagggtttttcacccgattgggtgatttggcaagctgacaaaggttggcaagcggatgaggttaatcccaatatgggcagttataacgctatccgcgtttatctctgggcgggcatgttggcagatgaagacccgcataaagtggcactagtgaaacaattccagccgatggtgcagatgaccacccagcttggtgtgccacccgaagaaacggataccgctacgggtaaaaccacgggttatggcccggttggcttctctgccgcgctactcccgctgttagccacccagcctgcggtactggctcaacaacgccagcgtctagcggatccattaccgagtgatgcctactttagtgcttctttgattctgtttggccagggttgggatcaacaacgttatcgttttaatcgtcagggtgaacttctaccctcttggggcagcaaatgcgtaactacagactag

SEQ ID NO: 2282 - DNA, 1134 bp, Yersinia sp.
atgccgatggtcgtgatgtttaaacgactggtatgcaccatgctgctgcttgccagttttggtagtgcggcagcgtgtgaatggcctgcatggcagcagttcaaacacgcttacattagcgacagtgggcgagttattgaccccagcagcccgcagaaaatcaccacctctgaagggcagagttatggactgtttttcgctttggttgctaacgaccggccaacctttgatcggttattgaactggacggaaaataatctggcggctggtgatcttactgccagtttgcccgcctggttatgggggcaaaatccgcaacatcactggggtgttctggaccctaactcagcctcggatgctgatttgtggattgcatacaacctgctggaagccgggcggttatgggatagccgccgttaccaaacgatgggcaccttgttactacagcgtattgccaaagaagaagtggtcagcattcccggccttggcaagatgctgttaccggggaaaattggttttaatggtagcgaccactggcggcttaaccccagttatttgcccccacagttgctggcgcgttttgcttctttaaccgggccgtggaaagcaatgattgatgtgaatcagcgcctatggctggaaaccgccccgcgtggttttgcgccggactgggtggtgtggcaaaaaggcaaaggttggcaaccagacgagatgaaaccgaatgttgggagctacgatgccattcgcagctatttgtgggcgggcatgttatccgataatagcccgcaaaaagccgcgttgatcaagcgcttccaacctatggcggccatgactcagcaacaagggctaccaccggaaaaaactgacactaacaccggtaaaacccgtggtaacgggccggtagggttttcggctgcgttactgccttttttagccagcagcccgacgccgtttgataagcagacccttgccctgcaacaacagcgggtgcaggattcgccaccgggtgatgatgcttattacagtgcggttctgacactgtttggacaggggtggtcacagaatcgttatcgttttaatcgtctgggtgagttacaaccttcatggaacggtcgatgcgcaacattaaaataa

SEQ ID NO: 2283 - DNA, 1116 bp, Pectobacterium sp.
atgccacgcgtgctgcgctacctgactcccacgctgctgtggctatgggcttccctggccaccgccgccgtctgcgactggccagcctgggagcagtacaagcagtattacatcagcgaggaaggacgggtgattgatacctcaacgcccaataaaatcaccacgtccgaagggcaaagctacgctctgttctttgcgctggtcgccaacgatcgcgtgatgtttgatcggctgctgaaatggacggaggacaacctgtccgcaggcgatttgcacgctaatttgcccgcctggctgtggggagagaacacggataaacagtggacggtgctggatccgaactccgcttccgatgccgatctgtggattgcctatagcctgctggaagctggtcggctgtggaaagagacacgctatcagacgctaggcaccgcgctgctcgcgcgcatcgccaaagaagaggtggtgacgattccggggctgggcgtgatgctattgcccggcaaagtgggcttcgcagagaaagagagctggcgcttgaaccccagctacctgccgccgcaacttctggcccgatttgcgccgctggacgagaagtggaaagccatgcagcgcaccacgcagcgcctgctgttggaaaccgcgccgaaagggttttcgcctgattgggtcatctggcaaaaaggcaaaggctggcagcccgataccaccaaacccaatgtcggcagctatgacgccatccgcgtctatctgtgggcggggatgatggccgacagcagcagagggaaaaccgatttgctcaaacagtttcagccgatggttcagcagacgatccggcaagggctaccgcccgaaaaagcggacaccgcgacaggcaccgtcaccggacagggatcggtagggttttccgcctcactgctgccgatgctatcccgccagccggatgccctggccgcccagcggcagcggctcgccgccaatccaccgggtgacgatgcgtatttctccgcctctctgacgctctttggtcagggatgggatcagaagcgctatcgcttcacttcacaaggccaacttttaccgtctcggggcagccaatgcacaaccacaccgtaa

SEQ ID NO: 2284 - DNA, 753 bp, Serratia sp.
atgaaaaagcgtttttctctgttggcaggaatgctgtttgcattaacgatgccggcgcatgccgccgagaataccgaagcgaaagcgatcgggccaaagcatggcgctaccttgattcccaaggcgcgtcaggtgatttgtgaacacgacggcggttacaaccacccggatgatggctcgaacatacctaatgcggcctgcagaaatgcctttttgtacaaagcggagactattcctatttgggaacgccgccagatgtttaccgaatggcccgcctactcgcaaaacctgcaaggtacccagcatccgtcagacaaggtccccgatggccagctttgctcggcgggcatcgccaagtttgaaggcatcgaccagccgcatgccgactggtatgtgagcagcgtctcggtaaaagacggccaggctacgctgtacttcgacgccacccaggtgcatgagccgagcaagtggacggtgtcgcttgccaagccgagtttcaatgccgccacggataagttgaaatggagcgatctgacaccgcttgaggtgactaaagtgacagttccgccgccggccaaaggcaaccatgtcaaatatgccggcgtctaccagattgaggtcaaaatcccggccgatcgtgctgacgggaagcaaacactgttgtatgtgcagtgggaacgacaggacccagcgagagaaacctttttcagctgtagcgacgtaaggttcaacggggaatccgcagccaaataa

SEQ ID NO: 2285 - DNA, 753 bp, Serratia sp.
atgaaaaagcgtttttctctgttggcaggaatgctgtttgcattaacgatgccggcgcatgccgccgagaataccgaatcgaaagcgatcgggccaaagcatggcgctaccttgattcccaaggcgcgtcaggtgatttgtgagcaggacggcggctacaaccacccggatgatggctcgaacattcctaatgcggcctgcagaaatgcctttttgtacaaagcggaaaccattcctatttgggagcgccgccagatgtttaccgaatggcccgcctactcgcaaaacctgcaaggtacccagcatccgtcagacaaggtccccgatggccagctttgctcggcgggcatcgccaggtttgaaggcatcgaccagccgcatgccgactggcaggtgagcagcgtctcggtaaaagacggccaggctacgctgtacttcgacgccacccaggtgcatgagccgagcaagtggacggtgtcgcttgccaagccgagtttcaatgccgccacggataagttgaaatggagcgatctgacaccgcttgaggtgactaaagtgatagttccgccgccggccaaaggcaaccatgtcaaatatgccggcgtctaccagattgacgtcaagatcccggccgatcgtgccgacgggaagcaagcgctgttgtatgtgcagtgggagcggctggacccagcgagagaaacctttttcagctgtagcgacgtaaggttcaacggggtctccgcagctaaataa

SEQ ID NO: 2286 - DNA, 2202 bp, Serratia sp.
atgcgtttatctacattggtgctggcgatcggcatggcgctgagcgcgcaggcacaggcagcagaaaccaatccgcacgcgagccatagcgcgttgcccagcggccaggcgaaggaggctaacgtgaccggagaagccaaccagcacgagaacaaaaagaacgagaacccgttcttctatcagagccgtctgccgttccaggcgccgccgttcaatctgatcaaagaaagcgactacgccccggctatcgacgccggcatcaagcaaaagctggaagaggtggagaagatcgccaataacccggccaagcccgattttaaaaatacctttgtggcgttggagcaggccggtgcgctgttgacgcgggtgatgaacgtttttggcgccatgacctcggccaacaccagcgacgcgctgcaaaagttggatgaggaaagctcgccgaaactggcggcgctcgaagacgccatcatgcttaacagcaagctgttcgcgcgcatcaaggcgatttatcagcagcgcgatgcgctgaagctggacgcggaatcgcgccgtctggtggaagtgacatacaagaactttgagctggcgggggccaacctgtccgatgccgataaaaccaggctgaaagcgctgaatcaggaagcggcgacgctgagcacccagttctccaacaagttgctggcagcgaccaaagacggggcgctggcgatagccgataaaggcaaactggacggcctgtcggaaagcgaactggcagcggcggctcaggcggccggcgagcgcaagctggacaaacagtggttgctggtgttgcaaaataccactcagcagccggagttgcagagcctgaaagacagggatacccgcaaggcattgtttgacgcttcgtggaaccgggcagaaaagggcgacggcaacgacactcgccagactatcgcccgcctggccaaggtgcgcgccgagcaggccaaattgctgggcttcccgaactatgccgcctggaaactgcaaaaccagatggccaaaaccccggatgcggcgctgagctttatgcgcaatatcgttccggcggccaccgcgcgtgccgaacgtgaagccaaagacattcaggcggtgatcgctcagcaaaaaggcgatttcaaggttgcagcctgggactggcagttctacgccgagcaggtgcgcaaggcgaaatacgatctggatgaatcgcagatcaaaccttacttcgaactggataacgtgctgaacaacggcgtgttctatgccgccaatctgctgtacggcatcagctttaaagagcgcaaggacatcccggtctaccagccggacgtgcgtgtgtatgaagtcttcgataaagacggcaaatcgctggcgctgttctataccgacttctttaagcgcgacaacaagggcggcggcgcctggatgagcaacttcgttgaacagtcgaagctgaagggcaccaaaccggtgatctacaacgtcgccaacttcaccaaaccggcgccgggtcagcctgcgctgctgtcgtacgacgacgtgatcaccctgttccacgagtttggccatgcgctgcacggtatgtttgccgatcaggagtatccgagcctgtccggcaccaatacggcgcgcgattttgtcgagttcccctcacagttcaacgaacactgggccagagatcccaaagtctttgcgcacttcgccaaacactacaaaaccggcgaagccatgccgcaggaactggtcgacaaaatcaaaaaagccgacaaattcaacaaagggtatgacatgaccgagctgctgtccgccgcgctgctggacatgcactggcacatgctgagcgcggatcagccgcagcaggacgtggacaagttcgaagccgaatcgctgctgaaggataaaatcgatctcagctacgtgccgccgcgttatcgctccagctatttcaagcatatctggggcaacgggtatgccgccggttactacgcctatctgtggaccgaaatgctggcggatgacgccttccagtggttcaccgagcacggcggcctgacggcggagaacggccaacgcttccgcgatagggtgctgtcgcgcggcaatagccaggatctggaaaaactgtatgtcgactggcgcggcaaagagcccagcatcgaaccgatgctgattaaccgcgggctgaaagacgaataa

SEQ ID NO: 2287 - DNA, 2202 bp, Serratia sp.
atgcgtttatctacattggtgctggcgatcggcatggtgctgacctcgcaggcacaggcagcagaaaccaacccgcacgcgagccatagcgcgttgccaagcggccaggcgaaggaggctaacgtgaccggagaagccaaccagcacgagaacaaaaagaacgagaacccgttcttctatcagagccgtctgccattccaggcgccgccgttcaatctgatcaaagaaagcgactacgctccggctatcgacgccggcatcaagcaaaagctggaagaggtggagaagatcgccaataacccggccaagcccgattttaaaaatacctttgtggcgctggagcaggccggtgcgctgttgacgcgggtgatgaacgtgtttggcgccatgacctcggccaacaccagcgacacattgcaaaagctggatgaggaaagctcgccgaaactggcggcgcttgaagacgcgatcatgcttaacagcaagctgttcgcgcgcatcaaggcgatttatcagcagcgcgatgcgctgaagctggacgcggaatcgcgtcgcctggtggaagtgacttacaagaacttcgagctggcgggggccaacctgtccgatgccgataaaaccaggctgaaagcgctgaatcaggaagcggcgacgctgagcacccagttctccaacaagctgctggcggcgaccaaagacggcgcactggcgatagccgataaaggcaagctggacggcctgtcggaaagcgaactggctgcggcgactcaggcggccggcgagcgcaagctggacaaacagtggttgctggtgttgcaaaataccactcagcagccggatttgcagagcctgaaagacagggatacccgcaaggcactgtttgacgcttcgtggagccgggcggaaaagggcgacggcaacgacactcgccagactatcgcccgcctggccaaggtgcgcgccgagcaggccaaactgctgggcttcccgaactatgccgcctggaaactgcaaaaccagatggccaaaaccccggatgcggcgctgagttttatgcgcaatatcgttccggcggccaccgcgcgtgccgaacgtgaagccaaagacattcaggcggtgattgatcagcaaaaaggcgatttcaaggttgaagcctgggactggcagttctacgccgagcaggtgcgcaaggcgaaatacgatctggatgagtcgcagatcaaaccttatttcgaactggataacgtgctgaacaacggcgtgttctatgccgccaacctgctgtacggcatcagttttaaagagcgcaaggacatcccggtctaccagccggacgtacgcgtgtatgaagtcttcgataaagacggcaaatcgctggcgctgttctataccgacttctttaagcgcgacaacaagggcggcggcgcctggatgagcaactttgtcgagcagtcgaagctgaaaggcaccaaaccggtgatttacaacgtcgccaacttcaccaaaccggcaccgggccagcctgcgctgctgtcgtacgacgacgtgatcaccctgttccacgagttcggccatgcgctgcacggcatgtttgccgatcaggagtatccgagcctgtccggtaccaataccgcgcgcgactttgttgagttcccctcacagttcaatgaacactgggccagcgatcccaaagtctttgcgcacttcgccaagcactacaaaaccggcgaagccatgccgcaggcactggtcgacaaaatcaaaaaagccgataagttcaacaaaggttatgacatgaccgagctgctatctgccgcgctgctggacatgcactggcacatgctgagcgcggatcagccgcaacaggacgtggacaagttcgaagccgaatcgctgctgaaggataaaatcgatctcagctacgtgccgccgcgctatcgctccagctacttcaaacatatctggggcaacgggtatgctgccggttactacgcctatctgtggacagaaatgctggcggatgacgccttccagtggttcaccgagcacggcggcctgacggcggagaacggccagcgcttccgcgacagggtgctgtcgcgcggtaatagccaggatctggaaaaactgtacgtcgactggcgcggcaaagagcccagcatcgagccgatgctgattaaccgcgggctgaaagacgaataa

SEQ ID NO: 2288 - DNA, 2202 bp, Multievos46 sp.
atgcgtttatctacattggtgttggcgatcggcatggcgctgagctcgcaggcacaggcagcagaaactaacccgcacgctgaccacaccgcgttgccgagtggtcaggcgaaggaggctaacgtgaccggtgaagccaaccagcacaacaataaaaagaaccagaacccgttcttctaccaaagtcgcctgccgttccaggcgccgccgttcaatttgattaaagagagcgactacgccccggcaattgatgccggtatcaagcaaaagctggaggaagtggagaagattgccaacaacccggccaagcctgattttaaaaataccttcgtggcgctggaacagtctggggcgttgctgtcacgcgtgatgaacgtgtttggtgccatgacctcggccaacaccagcgacgcgctgcaaaagttggatgaagaaagctcaccgaagctggcggcgctggacgacgccatcatgctcaacagcaaactgttcgcgcgtatcaagacgatttatcagcagcgtgatgcgctgaagctggatgcggaatctcgccgcctggtggaagtgacttacaaaaacttcgagctggcgggggccaatctctccgacgccgataaaaccaagctgaaggcgctgaaccaggaagcggcgacgctgagtacccagttctccaacaagctgctggcggcgaccaaagatggtgcgctggctatcgccgacaagggtaagttggacggattgtctgagagcgaactggccgctgccgctcaggccgccggtgagcgtaagctggacaagcagtggttactggtattgcaaaacaccacccagcagccggatttgcaaagcctgaaaaatcgagacacccgcaaggcgctgtttgacgcttcgtggaaccgggcagaaaagggtgacggcaacgacactcgccagacgattgcccgcctggccaaagttcgtgccgaacaggccaaactcttgggcttcccgaactatgcggcctggaagctgcaaaaccagatggccaaaacgccggatgcggcgctgagctttatgcgtaatatcgtcccggcagccactgcgcgtgccgaacgagaagccaaagacattcaggcggcttccgaccaacagaaaggcgatttcaaggttgccgcctgggattggcagttctatgccgaacaggtgcgcaaggcgaagtacgatctggatgaatcgcagatcaaaccttacttcgaattggataacgtgctgaacaacggcgtgttctatgccgccaacctgctgtacggcatcagcttcaaagaacgtaaggatatcccggtttaccagccggacgtgcgcgtgtatgaggtgttcgataaagacggcaaatcgatggcgctgttctataccgacttctttaaacgcgacaacaaaggcggcggcgcctggatgagcaacttcgtcgaacagtcgaagttgaaaggcaccaaaccggtgatttacaacgtcgccaacttcaccaaaccggcaccgggtcagcctgcattgctgtcgtacgatgacgtgatcaccatgttccacgagtttggtcatgcgttgcacggtatgttcgccgatcaggagtacccaagcctttcaggtaccaataccgcacgtgattttgtcgaattcccctcgcagttcaacgagcactgggccagcgatcctaaagtctttgcgcattacgccaaacactacaaaaccggtgaggccatgccgcaggaactggtcgataaaatcaaaaaagccgacaagttcaacaagggctacgacatgaccgagctgctgtctgcggcactgttggatatgcactggcatatgctgagcgccgatcagccgcagcaggacgtggataaattcgaagccgaatcgctgatgaaagacaagatcgatctcagctacgtgccgccacgctatcgctcaagctacttcaaacacatctggggtaacggctatgccgccggttattacgcctatctgtggactgaaatgctggcggatgacgccttccagtggttcagcgagcacggtgggctgacggcggagaacggccagcgtttccgcgatatggtgctgtcgcgcggcaacagccaggatctggagaagttgtacgtcgagtggcgcggtaaagaaccgagtatcgagccgatgttgatcaaccgcggtcttaaagacgaataa

SEQ ID NO: 2289 - DNA, 2202 bp, Serratia sp.
atgcgtttatcgacattggtgctggcgatcggcatggcgctgggcacgcaggcacaggcagcagaaaccaacccgcacgcggatcatagcgcgttgccaagtggccaggcgaaggaggcaaccgtgaccggtgaagccaaccaacacgacaacaaaaagaaccaaaacccgttcttctatcaaagccgtctgccattccaggcaccgccgttcaatctgatcaaagaaagtgattatgccccggcaattgatgcgggcatcaagcagaagctggaagagattgagaagattgccaacaacccggccaagcctgattttaagaatacctttgtggcaatggaacaaagcggcgcgttgctgtcgcgagtgatgaacgtctttggcgccatgacctcggccaacaccagcgacgggttgcaaaaactcgatgagcaaagctcgccgaagctggcggcgctggatgacgccatcatgctcaacagcaagctgtttgcccgtatcaaggccgtttatcaacagcgcgatgcgctgaagctggatgcggaatcgcgtcggctggtagaagtgacctataagaactttgagctggcgggggccaatctgtccgacgccgataaaaccaaactgaaggcgctgaaccaggaagcggcaacgctgagcactcagttctccaacaaattgctggcggcgaccaaagacggcgcattggcgattgctgacaaaggcaagctggatggcctgtcggaaggtgaactggcggcggcggcccaggcggccggcgaacgcaagctggataaacagtggctgctggtgttgcaaaacaccacccaacagccggaattgcagagcctgaaagaccgcgagacccgcaaggcactgtttgatgcttcgtggaaccgtgcggaaaagggcgacgctaacgacacccgtcagaccattgctcgtctggctaaagtgcgtgccgagcaggcgaaactgctgggcttcccgaattacgcggcctggaagctgcaaaaccagatggccaaaaccccggatgcggcgctgagttttatgcgtaatatcgttccggcggcgaccgcgcgtgccgaacgtgaagccaaagatattcaggcggtcatcggccagcagaaaggcggtttcaaggtcgaagcctgggactggcagttctacgctgaacaggtgcgcaaagccaaatatgacctggatgagtcgcagatcaaaccttacttcgaactggataacgtgctgaacaacggcgtgttctatgccgccaacctgctgtacggcatcagtttcaaagagcgcaaggacatcccggtttaccagccggacgtgcgggtttatgaggtgttcgataaagacggcaaatcattggcgctgttctataccgacttctttaagcgcgacaacaagggcggtggcgcctggatgagcaattttgtcgaacaatcgaagctgaaaggcaccaagccggtgatttacaacgtcgccaacttcaccaaaccggcaccgggccagcctgcgttgttgtcgtacgatgacgtgatcaccatgttccacgaatttggtcatgcgctgcacggcatgttcgccgatcaggaatatccaagcctgtccggcaccaacaccgctcgtgacttcgttgagttcccatcgcagtttaacgagcattgggccagcgatccgaaagtctttgcccacttcgccaagcattacaaaaccggtgaagccatgccgcaggaactggtcgacaaaatcaaaaaggccgacaagttcaacaaaggctatgacatgaccgagctgctttctgcggcactgctggacatgcactggcatatgttgagcgccgaccagccgcagcaggacgtggacaagttcgaggcggaatcgctgatgaaagacaaaatcgatcttagctatgtgccgccgcgctatcgctccagttacttcaagcacatttggggtaacggctatgctgccggttattacgcctatctgtggacagaaatgctggcggatgatgccttccagtggttcaccgaacatggcggcctgacggcagagaacggtcagcgtttccgcaatatgatcctgtcgcgcggtaacagccaggatctggaaaaactgtacatcgactggcgcggcaaagagccaagcattgagccgatgctgatcaaccgtggtttgaaagacgaataa

SEQ ID NO: 2290 - DNA, 2202 bp, Serratia sp.
atgcgtttatcgacattggtgttggcgatcggcatggcgctgggcacgcaggcacaggcagcagaaaccaacccgcacgcggatcatagcgcgttgccaagtggccaggcgaaggaggcaaccgtgaccggtgaagccaaccaacacgacaacaaaaagaaccaaaacccgttcttctatcaaagccgtctgccattccaggcgccgccgttcaatctgatcaaagaaagtgattatgccccggcaattgatgcgggcatcaagcagaaactggaagagattgagaagattgccaacaacccggccaagcctgattttaaaaatacctttgtggcaatggaacaaagcggcgcgttgctgtcgcgagtgatgaacgtctttggcgccatgacctcggccaacaccagcgacgggttgcaaaaactcgatgagcaaagctcgccgaagctggcggcgctggatgatgccatcatgctcaacagcaagctgtttgcccgtatcaaggccgtttatcaacagcgcgatgagctaaaactggatgcggaatcgcgtcggctggttgaagtgacctacaagaactttgagctggcgggggccaatctgtccgacgccgataaaaccaaacttaaggcgctgaaccaggaagcggcaacgctgagcacccagttctccaacaaactgctggcggcgaccaaagatggcgcattggcgatcgctgacaaaggcaatctggacggcctgtcggaaagcgaactggcggcggcggcccaggcggccggcgaacgcaagctggataaacagtggctgctggtgttgcaaaacaccacccaacagccggaattgcaaagcctgaaaaaccgcgagacccgcaaggcactgtttgatgcttcgtggaaccgtgcggaaaagggcgacgctaacgacacccgtcagaccattgctcgtctggctaaagtgcgtgccgagcaggccaaactgctgggcttcccgaattacgcggcctggaagctgcaaaaccagatggccaaaaccccggatgcggcgctgagttttatgcgtaatatcgttccggcggccaccgcgcgtgccgaacgtgaagccaaagatattcaggcggtcatcgaccagcagaaaggcaatttcaaggttgaagcctgggattggcagttttacgctgaacaggtgcgcaaagccaaatatgacctggatgagtcgcagatcaaaccttacttcgaactggataacgtgctgaacaacggcgtgttctatgccgccaacctgctgtacggcatcagtttcaaagagcgcaaggacatcccggtttatcagccggacgtgcgggtttatgaggtgttcgataaagacggtaaatcattggcgctgttctataccgacttctttaagcgcgacaacaagggcggtggcgcctggatgagcaattttgtcgaacaatcgaagctgaaaggcaccaaaccggtaatttacaacgtcgccaacttcaccaaaccggcaccgggccagcctgcgttgttgtcgtacgatgacgtgatcaccatgttccacgaatttggtcatgcgctgcacggcatgttcgccgatcaggaatatccaagcctgtccggcaccaacacggcccgtgacttcgttgagttcccatcgcagtttaacgagcattgggccagcgatccgaaagtctttgcccacttcgccaagcattacaaaaccggtgaagccatgccgcaggaactggtcgacaaaatcaaaaaggccgacaagttcaacaaaggctatgacatgaccgagctgctttctgcggcactgctggacatgcactggcatatgttgagcgccgaccagccgcagcaggacgtggacaagttcgaggcggaatcgctgatgaaagacaaaatcgatcttagctatgtgccgccgcgctatcgctccagttacttcaagcacatttggggtaacggctatgctgccggttattacgcctatctgtggacagaaatgctggcggatgatgcgtttcagtggttcaccgaacatggcggcctgacggcagagaacggccagcgtttccgcaatatgatcctgtcgcgcggtaacagccaggatctggaaaaactgtacatcgactggcgcggcaaagagccaagcattgagccgatgctgattaaccgtggcctgaaagacgaataa

SEQ ID NO: 2291 - DNA, 2202 bp, Serratia sp.
atgcgtttatccacattggtgctggcgatcggcatggcgctcggctcgcaggcacaggcagcagaaacccaacctcacgccgaccatagcgcgctgcccagcggccaggcgaaggaggctaccgtgaccggtgaagccaatcagcacgacaagcaaaagacccaaaatccgttcttctatcaaagccgtctgccgttccaggcgccgccgttcaacctgatcaaggaaagcgactacgcgccggcgatcgaagcgggcatcaagcaaaagcgggaagaggtggagaagatcgccaacaacccggccaagcccaactttaaaaataccttcgtggcgctggagcaggccggttcgctgctgacgcgggtgatgaacgtgttcggcgccatgacctcggccaataccagcgatgcgctgcagaagctggatgaagaaacctcgccgaagctggcggcgctgaacgacgacatcatgctcaacggcaagctgttcgcgcgcatcaaggccatctatcaagatcgcgatgcgctaaagctggatccggagtcgcgtcggctggtggaagtcacctataagaacttcgagctggcgggcgccaacctgtcggacgccgacaagaccaagctgaaggcgctgaaccaggaagcggcgacgctgagcacccagttcaccaacaaactgctggcggcgagcaaaaacggcgcgctggcgataaccgaccaggcgaagctggacggtctgtccgaaggtgagctggccgcggcagcgcaggcggccgccgagcgcaagctggagaaacagtggctgttggtgctgcagaacaccacccagcagccgctgctgcagagcctgaaagatcgcgatacccgcaaagcgctgttcgacgcctcctggacgcgtgcggagaagggcgacggcaacgatacccgccagaccatttcccgactggccaaggtgcgcgccgagcaggccaagctgttgggttacccgaactacgccgcctggaaactgcaaaaccagatggccaagacgccggatgccgcgctgagctttatgcgcaacatcgtgccggcggccaccgcgcgcgccgaacgtgaagccaaagatattcaggcggtgatcgaccagcagaaaggcgatttcaaggtgcaggcctgggactggcagttctacgccgaacaggtgcgcaaggccaagtacgatctggacgagtcgcagatcaaaccttacttcgagctgaacaacgtgctgaacaacggcgtgttctacgccgccaacctgctgtacggcatcagcttcaaagagcgcaaggacattccggtctaccagccggacgttaaggtgtatgaagtgttcgacaaggacggcaaatcgctggcgctgttctacaccgactacttcaaacgcgacaacaagggcggcggcgcctggatgagcaactttgtcgatcagtcgaagctcaatggcaccaagccggtgatctacaacgtcgccaacttcaccaaaccggcgccggggcagccggcgctgctgtcgtatgacgacgtgatcacgatgttccacgagttcggccacgcgctgcacggcatgttcgccgatcaggaatacccgagcctgtcgggtaccaacaccgcgcgcgacttcgtcgagttcccgtcgcagttcaacgagcactgggtcagcgatccgaaagtgttcagccacttcgccaagcactaccagaccggtgaggcgatgccgcaggaactggtcgacaagatcaagaaggccgacaagttcaacaagggctacagcatgaccgagctgctgtccgccgcgctgctggatatgcactggcacatgctgaccgccgatcagccgcagcaggacgtggacaagttcgaggccgagtcgctgcaaaaagacaaggtggatctcagctacgtgccgccgcgttaccgttccagctacttccagcacatctggggtaacggctacgccgcgggctactatgcctatctgtggacggaaatgctggcggacgacgccttccagtggttcaccgaacacggcggcctgaccgccgaaaacggccagcgtttccgcgacatgatcctgtcgcgcggcaacagccaggatctggagaagctgtacatcgactggcgcggcaaagaaccgagcatcgagccgatgctgatcaatcgcgggctgaaggacgagtaa

SEQ ID NO: 2292 - DNA, 2202 bp, Serratia sp.
atgcgtttatccacattggtgctggcgatcggcatggcgctgggcgcgcaggcactggcagcagaaacccaacctcacgccgaccatagcgcgctgcccagcggccaggcgaaggaggctaccgtgaccggtgaagccaatcagcacgacaagcaaaagacccagaatccgttcttctatcaaagccgtctgccgttccaggcgccgccgttcaacctgatcaaggagagcgactacgcgccggcgatcgaggcgggcatcaagcaaaagcgggaagaggtggagaagatcgccaacaacccggccaagcctaatttcaagaataccttcgtggcgctggaacgggccggttcgctgctgacgcgggtgatgaacgtgttcggcgccatgacctcggccaacaccagcgacgcgctgcagaaactggatgaagaaacctcgccgaagctggcggcattgaacgacgacatcatgctcaacggcaagctgttcgctcgcatcaaggccatctatcaggatcgcgatgcgctgaagctggatccggaatcgcgccggctggtggaagtgacctacaagaacttcgagctggcgggcgccaacctgtcggacgccgacaaggccaagctgaaggcgctgaaccaggaagcggcgacgttgagcacccagttcaccaacaaactgctggcggcgagcaaaaacggcgcgctggcgataaccgacccggcgaagctggacggcctgtcggaaggcgagctggctgcggcggcccaggcggccgccgaacgcaagctggagaaacagtggctgctggtgctgcaaaacaccacgcaacagccgttgctgcagagcctgaaagatcgcgatacccgccaagcgctgttcgacgcctcctggacgcgtgcggagaagggcgacggcaacgatacccgtcagaccatttcccgtctggccaaggtgcgcgccgaacaggccaagctgctgggctacccgaactacgccgcctggaaactgcaaaaccagatggccaagacgccggatgccgcgctgagctttatgcgcaacatcgtaccggcggccaccgcgcgcgccgagcgtgaagccaaagacattcaggcggtgatcgaccagcagaaaggcgatttcaaggtgcaggcctgggactggcagttctacgccgaacaggtgcgcaaggccaagtacgatctggacgagtcgcagatcaagccttacttcgagctgaacaacgtgctgaacaacggcgtgttctacgccgccaacctgctgtacggcatcagcttcaaagagcgtaaggacattccggtctaccagccggacgtcaaggtgtatgaagtgttcgacaaggacggcaaatcgctggcgctgttctacaccgactacttcaagcgcgacaacaagggcggcggcgcctggatgagcaacttcgtcgatcagtcgaagctcaacggcaccaagccggtgatttacaacgtcgccaacttcaccaaaccggcaccgggccagccggcgctgctgtcgtatgacgacgtaatcacgatgttccacgagttcggccatgcgctgcacggcatgttcgccgatcaggaatacccgagcctgtcgggcaccaacaccgcgcgcgacttcgtcgagttcccgtcgcagttcaacgagcactgggtcagcgatccgaaagtgttcagccacttcgccaagcactaccagagcggcgaggcgatgccgcaggaactggtcgacaagatcaagaaggccgaaaagttcaacaagggctacagcatgaccgagctgctgtccgccgcgctgttggacatgcactggcacatgctgaccgccgaccaaccgcagcaggacgtggacaagttcgaggccgaatcgctgcaaaaagacaaggtcgatctcagctacgtgccgccgcgctaccgttccagctatttccagcacatctggggtaacggctacgccgcgggctactacgcctatctgtggacggaaatgctggcggacgacgccttccagtggttcaccgaacacggtggcttgaccgccgaaaacggccagcgcttccgcgacatgatcctgtcgcgcggcaacagccaggatctggagaagctgtacatcgactggcgcggcaaagagccgagcatcgaaccgatgctgatcaaccgcgggctgaaggacgagtaa

SEQ ID NO: 2293 - DNA, 2202 bp, Serratia sp.
atgcgtttatccacattggtgctggcgatcggcatggcgctgggctcgcaggcacaggcagcagaaacccaacctctcgccgaccatagcgcgctgcccagcggccaggcgaaggaggcaatcgtgaccggtgaagccaatcagcacggcaaacaaaagacccaaaatccctttttctatcaaagccgtttgccgttccaggcaccgccgttcaacctgattaaggaaggcgactacgcgccggcgatcgcagcgggcatcaagcaaaaacgggaagaggtggagaagatcgccaacaatcctgccaaacctactttcaagaataccttggtggcgctggagcaggccggttcactgctgacgcgggtgatgaacgtgtttggcgccatgacctcggccaataccagcgacgcgctgcaaaagctggatgaagagacctcgccgaagctggcggcgttgaacgacgatatcatgctcaacggcaagctgttcgcccgcatcaaagccatttatcaggatcgcgatgcgctgaagctggatccggagtcgcggcggctggtggaagtgacttacaagaacttcgagctggcgggcgccaacctgtcggacgcagataaggcccagctgaaggcgctgaaccaggaagcggcgacgctgagcacccagttcaccaacaaactgctggcggcgagcaaaaacggcgcgctggcgattaccgaccaggcgaaactggacggcctgtcggaaggcgaactggccgcggcggcgcaggcggccggcgaacgcaagctggagaaacagtggctgctggtgttgcagaacaccacgcaacagccgttgctgcagagcctgaaagatcgcgacacccgcaagacgttgttcgatgcctcctggacgcgcgccgaggccggggacggcaacgatacccgccagaccctttcccgcctggccaaggtgcgcgctgagcaggccaaactgctgggctacccgaactacgccgcctggaaactgcaaaaccagatggccaagacgccggatgcggcgttgagcttcatgcgcaacatcgtgccggcggccaccgcgcgcgccgagcgtgaggccacggatatccaggcggtgatcgaccggcaaaaaggcgatttcaaggtgcaaacctgggactggcagttctacgccgaacaggtgcgcaaagccaagtacgatctggacgagtcgcagatcaagccttacttcgagctgaacaacgtgctgaacaacggcgtgttctacgccgccaacctgctgtacggcatcagcttcaaagagcgtaaggacattccggtctaccaagcggacgttaaggtgtacgaggtgttcgacaaggacggcaagtcgctggcgctgttctacaccgactacttcaagcgcgacaacaagggcggcggcgcctggatgagcaacttcgtcgatcagtcgaagctcaacggcaccaagccggtgatctacaacgtcgccaacttcaccaaaccggcaccggggcagccggcgctgctgtcgtatgacgatgtggtcacgatgttccacgagttcggccatgcgctgcacggcatgtttgccgatcaggaatatccgagcctgtcgggcaccaacaccgcgcgcgatttcgtcgagttcccgtcgcagttcaacgagcactgggtcagcgatccgaaagtgttcagccacttcgccaagcactaccagaccggcgaggcgatgccgcaggaactggtcgacaagctcaagaaggccgacaagttcaacaagggttacagcatgaccgagctgttgtccgccgcgctgctggacatgcactggcacatgctgactgccgaccagccgcagcaggacgtggacaagttcgaggccgagtcgctgcaaaaagacaaggtcgatctcagctacgtgccgccgcgctaccgttccagctacttccagcacatctggggtaacggctacgctgcgggctactatgcctatctgtggacggaaatgctggcggacgacgccttccagtggttcaccgaacacggtggcctgaccgccgagaacggccagcgcttccgcgacatgatcctgtcgcgcggcaacagccaggatctggaaaagctgtacatcgactggcgcggcaaagagccgagcatcgagccgatgctgatcaaccgcgggctgaaggacgaataa

SEQ ID NO: 2294 - DNA, 2202 bp, Serratia sp.
atgcgtttatccacattagtgttagcgatgagcatggcgttaggcacgcaggcgcaggccgaggagagcaaaaccacctctgaacatgcggcgctgccgagcggccaggcgaaggaggcgacggtgaccggcgaagccaaccagcacgagaaccagaaaagcgacaacccgttcttctaccagagccgtctgccgtatcaggcgccgcctttcgaccggattaaggaaagcgactacgcgccggcgattgaagagggcatcaaacagaaactggcggaagtggaaaaaatcgccaacaacccggccaaggcggattttgacaataccctggtggcgctggaaaaaaccggcgcgctgctgacgcgggtgatgagcgtgttcggcgccatgacttcggccaacaccagcgacgcgctgcagaagctggatgaagaagtctcgccgaaactggcggcgatggatgacgccattatgctcaacagcaagctgtttgcgcgtattaaggcggtgtatgagcagcgcgacgcgctgaagctggatgcggaatcccgccgtctgctggaggtggcctaccagagctttgaactggccggcgccaacctgtcggacgccgacaaaaccaaactgaaggcgctgaaccaggaagcggcgaccctcagcacccagttcaccaataaactgctggcggcggcgaagaacggcgcgctggccatcagcgacaagagcaagctggacggcctgtccgccggcgagctggcggccgcggcccaggcggccagcgagcgcaaactggacaagcagtggctgctggtgctgcagaataccacccagcagccggatctgcagacgctgaaggatcgcgatacgcgcaaggcgctgttcgacgcttcgtggacgcgcgccgagaagggcgacggcaacgacacccgtcagaccatcgcccggctggcgaagatccgcgccgagcaggccaagctgctgggcttcccggactacgcctcgtggaaactgcaaaatcagatggcgaaaacgccgaaggcggcgctgagctttatgcgcgatatcgtaccggcggccaccgcgcgcgcacagcgtgaggcgaaggatatccaggcggtgatcgaccggcagaaaggcgatttcaaactggtggcctgggactggcagtactatgccgagcaggtgcgcaaggagaagtacgatctggatgaatcacagatcaaaccttactttgagctgaataacgtgctgaacaacggcgtgttctacgcggctaacctgctgtacggcatcagctttaaacagcgcaaggatattccggtgtatcagccggacgtgcgggtgtatgaggtgtttgataaggacggtaaatcgctggcgctgttctataccgactactttaagcgcgacaacaagggcggcggcgcctggatgagcaacttcgtcgagcagtcgaaactcaacggcaccaaaccggtgatttacaacgtcgccaacttcaccaaaccggcgcccggccagccggcgctgctgtcgtatgacgatgtgatcaccatgttccacgagttcggccatgcgctgcacggcatctttgccgatcagcagtacccgagcctgtccggcaccaataccgcgcgcgattttgttgagttcccgtcgcagtttaacgagcactgggcgcgcgacccgaaagtcttcgcccacttcgccaagcattaccagaccggcgcggcgatgccgcaggaactggtcgacaagatcaacaaggccgacaagttcaacaagggctacgacatgaccgaactgctggcggcggcgctgctggatatgcactggcatatgctgagcgccgaccagccgcagcaggatgtcgaccagtttgaggcgcagtcgctgcagaaagataacatcgatctcagctatgtgccgccgcgctaccgttccagctacttccagcatatctggggcaacggctacgccgccggctattacgcctatctgtggactgaaatgctggcggacgacgccttccagtggttcagtgaacacggcggcctgacggcggagaacggccagcgcttccgcgatatggtgctgtcgcgcggcaacagcgaagatctggagaagctgtatgaaacctggcgcggtaaggcgccgagcattgagccgatgctgattaaccgcggcctgaaagagcagtga

SEQ ID NO: 2295 - DNA, 2202 bp, Serratia sp.
atgcgtttatcaaccctggtactggcgatcggcgtggcgctgagtacgcaagcgctggcagaagagagcaagttgccgtcagaaaacaccgccgtgccaagtggccagtctaaggaggcgaatgtgaccggagaagccaatcaacatgaggataagaaaggcgaaaaccctttcttttatgctagccggctgcctttccaggcgccgccattcggggtaatcaaagaaagcgattatgccccggccattgccgctggtatccaacagaaactggctgaagttgagaagatcgccaataatccggcggagccgacctttgaaaataccttggtggcgctgcaaagcagcggagcgctgttgacgcgcaccatgaacgtgtttagtgcgatgacatcggccaacaccagcgacgccctgcaaaagctggatgaggaaacgtcgcccaagctggcggcgttggatgacgccatcatgcttaacagcaagctgtttgcgcgcatcaagtcgatttatgatcgacgcgatagcctggaactggatgccgaatctcgccgcctggcggaagtcacctaccaaaattatgttctggccggggccaacctgtccgacacggataaaacccagttaaaagcgctgaatcaggaagcggcgacgctgagcacccagttcaccaacaaactgctggcggccggcaaaaacggcgccttggcgattgatgacaaagcgcaactgactggcctttccgatgctgaacgtgcggcggcggcgcaagccgccagcgagcgcaagctggataaacagtggttattggttttgcagaacaccacgcaacagcccgatctgcaacgcctgaaagatcgtgatacccgcaaagcgttatttgatgcttccgtcaaccgcgcggagaaaggggatgccaatgatactcgccaaaccgtggcgcggctggcgaaagtgcgtgccgaacaggccaaactgctgggcttcccgaattatgccgcctggaagctgcaaaaccagatggctaaaacccctgatgcggcattggcgtttatgcgcgatatcgtgcctgccgccacggcccgggccgaacgcgaagccaaagatattcaggcggttatcgatcagcagaacggtggcttcaagttggcggcctgggactggcagttctacgccgaacaggtgcgcaaagcgaagtacgatctggatgaatcacagatcacaccttactttgagttgaataatgtgctgcataacggcgtgttttatgctgccaatctgctgtatggcatcagctttaaagagcgcaaggatattccggtctaccagccggacgtgcgggtgtatgaggtgttcgataaagacggcaaatccctggcgctgttctacaccgacttcttcaagcgcgataacaagggcggcggcgcctggatgagcaatttcgtggagcaatccaggctcaatggcaccaaaccggtgatctataacgtcgccaactttaccaaacccgcggcgggccagccggccttattgtcttatgacgacgtgattaccctgttccatgaattcggccatgcgctgcacggaatgttcgccgatcaggaatacccaagcctttccggcaccaataccgcccgtgattttgtcgaattcccgtcacaatttaacgaacactgggccagcgatcccaaggtattcgcccactatgccaggcattaccaaaccggcgaagcaatgccgcaggaactggtcgataagatcaacaaagccgataaattcaataaaggctacgccatgaccgagctgttggccgcggcgctgttggatatgcactggcacatgctggccgccgggcaaccgcagcaagccgttgacaaattcgaagcggcgtcgttgcaacaggacagcatcgatctcggttacgtgccgccgcgttatcgttccagttattttcaacatatctggggcaacggttatgcggccggttattacgcctatctgtggactgaaatgttggcggatgacgccttccaatggttcaaagaacatggcgggttgacggcggagaatggccagcgcttccgtgacaaaatattgtcacgcggtaacagtcaggatctggaaaagctgtatgttgactggcgcggacaagaaccgagcattgagccgatgctgctcaaccgtgggttgaaagatcggtga

SEQ ID NO: 2296 - DNA, 2163 bp, Serratia sp.
atgcgtttatcaaccctggtactggcgatcggcgttgcgttaagcatgcccgcgctggcagaaacccatacccagacaaaggaggcgaaagtggccggagaagttaaacaggataagcagggagaaaacccgttctttgccgccagtcagttgccattccaggcccctcgttttgatgtcatcagcgaaagcgattatgccccggccattgccgccggtatccagcagaaactggcagaagtcgaaaagatcgccaataacccggctgagcctacgtttgacaataccttcgtggcgctggaaaaaagtggcgcactgctgacgcgcaccatgaacgtgttcggagcgatgacctccgccaacaccagtgacacactgcaaaagctggatgaagaaacctcaccgaagctggcggcgttagacgatgccatcatgctcaacagcaaactgtttgcgcgcatcaaggcgatttacgatcggcgtgatagcctcaacttggaccccgagtccttgcggctggtagaggttacctacaagaactatgtgctggccggggccaatctttctgaagcggataaaacccaacttaaagcgttgaaccaggaagcggcgacgctgagtacccagttcaccaataaattactggctgccagcaaaaacggcgcgttggcgataggtgataaaaacctgctggccgggctttcagagggcgagttggcggcagcagcgcaggcggccagtgaacgcaagctggataagcaatggctgttggtattgcagaacaccacgcaacagcctgatttgcaaaacctgcaagatcgcgatactcgccaaaagttgttcaaagcttcgatcaaccgcgcagaaaaaaatgacgccaacgatacccgtcaaaccctggcgcggttagctaaagtgcgtgccgagcaggccaaactgctgggcttcccgaactatgccgcctggaagttgcaaaatcagatggcgaaaaccccggatgcggcgttggcgtttatgcgtaatatcgtgcctgccgctacggcccgggcagagcgtgaggccaaagacattcaggcagtgatcgatcggcaaaacggcggttttcagctggccgcctgggattggcagttctatgccgagcaggtgcgtaaagagaagtacgatctggatgaatcacagatcaagccttactttgagatgaacaacgtgctgcataacggcgtattctatgccgccaatttgctgtacggcatcagctttaaagaacgtaaagatatcccggtttatcatcctgacgtgcggatatacgaggtatttgataaagacggccagtctctggcgctgttctacaccgatttctttaagcgagacaacaagggcggcggcgcctggatgagcaacttcgttgagcagtccaaactcaacggcaccaagccggtgatttacaacgtctccaacttcaccaaacccgcatcgggccaaccagcgttgctgtcctatgatgacgtgataaccatgttccacgagtttggccatgcgctgcacggcatgtttgccgatcagcaatatccaagcctgtccggtaccaacactgcccgcgattttgtcgagttcccgtcgcagtttaacgagcactgggccagcgatccgcaggtatttgcccactttgccaagcactaccaaacgggtgaagcgatgccgcaggcgttggtcgataaaatcaacaaggccgacaagttcaacaagggttacgccatgaccgaactgttggccgccgcgctgctggatatgcattggcatatgctcggcgccgatcagccgcagcaggacgtggacaagttcgaggccgcatcgctgcgccaggacaagatcgacctcagctatgtgccaccacgctatcgctccagctatttccagcatatctggggcaatggctatgcggccggttattacgcctatctgtggacggagatgttggcagatgacgccttccaatggttcagcgataacggcggactaacggcagaaaatggccagcgtttccgtgagcaggtgttgtcacagggcaacagccaggatttggaaaagctgtacgttaaatggcgtgggcaggagccgagtattgaaccgatgctgatcaaccgcgggctgaaggataagtaa

SEQ ID NO: 2297 - DNA, 2208 bp, Xenorhabdus sp.
atgcgtttatccactttagtactggctattggcttggcactaggcacccaagcgcaggccgaagaaaataaactgggatctgaccacacgaacgtatcaagtaatcaaataaagcaggtgaatgtgaccggtgaggctaatcaacaacaatacaagaagaacaaaaatcctttcttctccccaagtgtactaccgttccaggctcctccgttcaataagataaaagaaacagactatgcacccgcgattgctgccggtattaaacagaaactgaaggaggtagagaagatcgccaataatcccgccccccctgattttaaaaatacatttgtcgcgctggagaaatcgggcgcaatgttgacacgggtgatgaacgtatttggggcgatgacatcggctaataccactaacgggctgcaaaaactgaatgaggaaacttcaccaaagctggcggcgatgaatgatgaaattatgctgaacagtagactgttcaaccgtatcaaagccatttaccagcagcgcgggacgttgaatctggatccagaatcgcgtcgattggtggaagtgacttatcaaaatttcgagttagcgggagccaacttgtctgatgcggataaagcaaagttaaaggctttgaatcaggaagcagcaacactcagtacccagtttaccaacaaactgctggcggcaaccaaaaatggtgcgctggcgattcaagataaagccaggctggacgggctgtccgatggcgaaattgccgcggctgcgcaggccgccagtgagcgtaagctagacaaacaatggctgttggtattgcaaaacaccacccaacagccgagtctgcaaaacctgaaagatcgcgatacgcgtaaagcgttatttgaggcatcgtggacccgagctgaaaaaggtgacgataatgatacgcgtcaaactctggcccggttagcgaagatccgtgctgagcaagctaagctgctgggcttcccggattatgcatcgtggaaactgcaaaatcagatggccaaaacgcctaaaaccgcattgaaatttttgcgtgatattgtacctgcggccaccgcacgcgctgagcgcgaagccaaagacattcaggcggtgattgaccaacaaaaagggggcttcaagctggaagcctgggactggccgttttatgccgaacaggtacgcaaagcaaaatatgatttggatgaatcacagattaagccgtatttcgaactgaataacgttctgaataatggcgtgttctatgccgccaatctgctgtatggcattacctttaaggagcgcaaagacatcccggtttatcagcccgacgtccgcgtgtatgaagttttcgataaagacagaaagccgctggcgttgttttataccgattactttaagcgcgacaacaaaaatggtggagcctggatgaataattttgtcgatcagtcaaagctcatcggaaccaagccggtgatttacaacgtcgccaactttactaaacctgcgccgggccaaccagcactgttgtcgtatgatgacgtgatcacaatattccatgagtttgggcacaccttgcatggtatgtttgccgatgagaaatatccgagcttgtccggtacaaataccgcccgtgattttgtggaatttccatcacaatttaacgagtattgggcgcgcgatccaaaggtgtttgcccattatgccaagcattaccagaccggagaagcaatgccacaagcattggtagataagatcaataaggctgacaaattcaacaaaggttatagcatgaccgagctgctgtcagccgcattgttggatatgcactggcatatgctgaccgctgctcagccacaacaggacgtggataagtttgaagccgagtctctgcaacaagacaacatctatctcagctacgtaccgccgcgctatcgttccagctacttcaagcatatttggggcggcggttatgctgccggttattatgcttatctgtggacagaaatgctggcagacgatgcttttgcctggtttaccgaacacggaggtctgacggcagagaatggccaacttttccgcgataaggtgttgtcacgtggtaatagtgaagacttggaaaaactgtatatcaactggcgcggtaagccaccgagtattaagcatatgctgaaaaaccgaggcctggaggaacaaaaacaataa

SEQ ID NO: 2298 - DNA, 2196 bp, Xenorhabdus sp.
atgcgtttatccactttagtactggctattagcttggcactcagcgctcaagcacaggccgaagaaaataaactgggatctgataacacaaacatatccagtgatcagataaaggaggcaaatgtgaccgatggtactgatcaacagcaatacaagcataaaaatccttttttctacccaagtgccttaccgtttcaggctcctccgttcgataaggtaaaagaagccgactatgcgccggcaattgctgccggtattaaacagaaactggcagaagtggcaaagatcgccaataatcccgcccccccgaactttaagaatacctttgttgcgctggagaaatcgggcgcaatgctaacacgggtgatgaatgtgtttggggcgatgacgtcggctaacaccactgaccaactgcaaaaactggatgaagaaatgtcccccaagctggcggcgatggaggatgaaattatgctgaacagtcaactgttcagccggatcaaaaccatttatcagcaacgcgagacattaaaactggcccccgaatcgcgccgattggtggaagtcacttatcaacgcttcgagttagcaggagccaacttgtctgatcaagataaggcaaaattaaaggctttaaatcaggaagcagcaacgctcagtactcaatttaccaacaagctgctgacggcaaccaaaaatggcgcactggcaattcaggataaagctaagctgaacggattgtctgatggcgaaattgccgcggctgcgcaggctgccagtgaacgtaaactagacaaacaatggctgttggtattgcagaacaccacccagcaaccgggtttgcaagacctgaaagatcgcgatacacgtcaggcgttattcgacgcatcatggagccgggctgaaaaaggtgatgataatgacacacgccaaaccctgacccgactggcgaaagtccgtgctgaacaggctgcgctgctgggtttcccagattatgcctcatggaaactgcaaaaccagatggcaaaaacacctgaagccgcattgaaattcttgcgtgatattgtacctgcggccactgcacgcgctgaacgcgaggccaaagacattcaggcggtgattgaccaacaacaaggaaatttcaagctggaggcttgggattggccgttttatgccgagcaggtacgcaaagcaaaatatgatttggatgaatcacaaatcaagccctatttcgagctgaataacgtcctgaacaatggcgtgttctattccgccaatctgctgtacggcataacctttaaagagcgcaaagacattccggtttatcaagccgacgtgcgtgtatatgaagttttcgataagaacaggaagccgttggccctgttttataccgattactttaagcgcgacaataaagggggtggagcctggatgagtaattttgtcgaccagtcaaaactcttcggcaccaagccggtgatttataacgtcaccaactttaccaaacctgcgccgggtcaacctgcactcttgtcatatgatgacgtgagcacgctgttccatgagtttggacatgccctgcacggcatgtttgccgctcaagaatatccgaccttgtccggtaccaataccgcccgtgatttcgtggagtttccctcacaatttaatgagtattgggcacgtgatccaaaggtatttgcccattacgccaagcattaccaaacgggtgaagcaatgccgcaggcgttagtggataaaatcaataaggcagataaattcaacaaaggttatctcatgaccgaattgctgtcagccgcgctgctggatatgcactggcacatgctggccgctgatcagccacaacagaacgtggatacctttgaggccaacgctctgaaacaagacaacatcaatctcagttacgtgccaccacgctatcgttccagctacttcaaacacatttggggtggcggttatgctgctggttactatgcttatctgtggacagaaatgctggcagacgatgcttttgcctggtttaccgaacacggcggcctgacaccagataatggtcaacgtttccacgataaagtgttgtcacgcggtaatagtaaagacttggaaaaactgtatattgactggcgcggtaagccaccgagtattgagcatatgctgaaaaaccggggtctgaaggaataa

SEQ ID NO: 2299 - DNA, 2193 bp, Xenorhabdus sp.
atgcgtttatccattttagtattgtctattggcttggcactcggtactcaagtgcaggccgaagaaaataaactgggatctgaccacaaaaatacatcaagtggtcaagcaaaggagttaaatgtgactgatcaaactcaagaacaatacaaacataaaaatcctttcttctcgccaagtaaacttccatttcaagcaccaccgttcgataagataaaagaatcggactatgcacctgccattactgccggtattaaacagaagctggaagaagtgaagaagatcgccaataacccggccaaacccagctttgaaaatacctttgtcgcgctggagaaatcgggggcaatgctgacacgggtaatgaacgtatttggggcaatgacgtcatctaactccactcaaaaactgcaagacttggatgagaaaatgtcacccaagctggcagcgatggatgatgaaattatgctgaacagtaaactattcagccgaatcaaaacgatttatcagcaacgcgggacattgaagctggaccccgaatcactccgattggtggaagtgacttatctacgtttcgagctggcgggagccaacttatctgatgcagataaggtcaaattaaaggcgttgaatcaggaagccgccacactcagtacacaattttccaacaaactgctgctggcaacccgaaatggtgcattggcgattaaagataaaatcaagctggatgggctgtccgacagtgaaatcgctgcggctgcgcaggctgccagtgaacgtaatctggataagcaatggttgttagtcttgcaaaacaccacccaacaaccgaatctgcaagatctgaaagatcgtgatacacgtaaggcgttatttgaagcatcgtggacccgtgctgaaaaaggggatgataatgacacacgccaaaccctgacccgattagcgcagatccgtgctgaacaggctaaactactgggttttccggattatgcatcctggaagctgcaaaatcagatggcaaaaacccccaaagctgcgttgaaatttttacgtgatattgtccccgcagccactgaacgcgctaaacgcgaggccaaagacattcaggcagtgattgaccagcaacaaggcggcttcaagctggaagcttgggattggccgctgtatgccgagcaggtacgcaaagcgaaatacgacttggatgaatcacaaattaagccttatttcgagctgaataacgtcctgaacaatggcgtgttctatgccgccaatttactgtatggcattactttcaaagagcgtaaagacattccggtttatcaccccgatgtccacgtatatgaaattttcgataacaacaaaaaaccgttggcgttgttttataccgattactttaagcgtgacaacaaaagtggtggcgcctggatgagcaattttgtcgatcaatcaaagctcaccggcaccaaacccgtgatctacaacgtcacaaactttactaagcctgcaccaggccaggccgctctcttgtcatatgatgatgtgataaccctgttccatgagtttggtcatgccttgcacggtatgtttgcctcccaggaatacccgagcctgtccggtacgaataccgcccgtgattttgtggaattcccatcacagttgaatgagtattgggcacaggacacaaaaatatttgcccattacgccaagcattaccaaacgggtgaaccaatgccacaggcattggtggataaaatcaagaaagctgacaaattcaacaaagggtatcagatgacagaactgctgtccgcggcattgctggatatgcactggcatatgctgggggcagatcaaccgcggcaggacgtggataaatttgaagccaacgctctgaagcaagataacattgacctcagctacgtaccgccgcgttatcgttccagctatttcagccacatttggggcggtggttatgcggcaggttattatgcttacctgtggactgaaatgctggcagacgacgcttttgcctggtttaccgaacatgggggtttaacgccagagaatggtcaacgcttccgggacaaaatactgtcacggggaaacagtgaagacttggaaaaactctatgttgactggcgcggtaagccaccgagcatcaagcacatgctgaaaaaccgggggctggaggaataa

SEQ ID NO: 2300 - DNA, 2172 bp, Yersinia sp.
atgcgtttatctacgttggttttagcgatgagtatggcactcgccgggcaggtccaatccgcagaaatagcggtaaaggggcagttaaataaacctcagttggaagatgaagctaatcgggtcggtcaaaatccgttctttagctcgagtaaactacctttccaggcaccgccgtttaatcttattaaggaaagcgactatgcgccggcgattgaatttggaattgccgaacgtttggcagaggttaatgctattgcaaataatcctacactgccaacctttaaaaatacctttatagcgttggagaaatcagggggaactttaacccgagtgatgaacggatttggcgcaatgacatcggccaattcaagtgatgtcctgcaaaaaatagatgaagaaacctcgccaaaactggcggctatggaagatgctatcaagctgaatagcacactgtttaatcgtattaaaacaatatatgaccagcgagataaactcggtctggacgatgaatcgagacgtttggtggaagtgacttacactaacttcattctggcaggcgcgaatctttctgatgcggataaaaccaaacttaaagctttaaatcaggaagcggctggtctgagcactcaatttaccaataaacttttggctgcaaccaaaaacggtgcggtggcagttaaagacaagtctgttttagcggggctgtcagagggggaattagccgcagcggcgcaggctgccggcgaccgtcaactggataaacaatggctattggtattgcaaaataccacccagcagccggtgctaaaaaatcttagcgaccgagatacgcgaaaatcgttgtttgatgcatcgtggaatcgagccgagcagggggatgccaatgacactcgccagatagtatctcgtttggcaaaaatacgggctgaacaggctcaactccttggtttcccgaattatgctgcttggaaattacagaaccaaatggcaaaaacccctgatacggcactgactttcatgcgtgatatcgtaccggctgcgaccgcacgtgccgagagggaagcaaaagatattcaagcggttatcgatcgtcagaacggtggatttaagctggggccagaagattggaaattctatgcggaacaggtgagaaaagaaaaatatgatctggatgaatcacaaataaacccctactttgaactggacaatgtactgaataacggcgtgttttacgcggcgaatcaactgtttggtattagttttaaagaaaggacagatttgccggtttatcatccagacgttcgggtttatgacgttattgataaagacggtcagcctttggcgttgttctacaccgattatttcaagcgtgacaacaaaggtggcggtgcctggatgagcaattttgtcgatcagtcgaaattgttaggtaccaaaccggttatttataatgttgctaacttcacaaaaccggctcctggacagccagcattgctgtcatatgacgatgtcattacgctgttccatgagtttggtcatgccctgcatggcatctttgccgatcagcaatacccaagcctgtctggcaccgcgacggcgcgagatttcgtcgagtttccatcacagttaaacgaacattgggccagcgatccaaaagtgttcgccaactatgccaaacattataaaaccggcgagccaatgccgcaggagttagtcgataagattcagaaagccaaaaaattcaataaaggttatagcatgaccgagctgctttctgcggcattgctggatatgaactggcatatgctaaacgccagtcagctggagcaggatgttgataaatttgagaaaaaatcgttacagcgagataaaattgatctgagttatgtccctccacgttaccgttccagttatttccaacatatctggggtaatggttatgccgcaggttattacgcatatttatggactgaaatgctggccgatgatgcttttgttggtttattagaaagcggtgggctaacgccggaaaatggtcagcgcttgcgtgataaaatcctatctcggggtaacagtcaggatctggaaaaactttatattgattggcgcggccaagctccaagtattgagccaatgttaatcaatcgtggtttgaaggaacccgctaaataa

SEQ ID NO: 2301 - DNA, 2172 bp, Yersinia sp.
atgcgtgtatcaactttagttttagccatgagtatggcacttacagggcaggggcactctactgaaacgctcagcagtgacccaaataataaatcgcggttgagtgggaaaacggatgttaaaagtccaaatccctttgttagccgtagttcgttgcctttttctgcgccaccttttgatctgattaaagaaagtgactatgagccggcgatcgatcttggtatcgctgagcgtttggcagaagtggatgccatcgccaataatccgacgccgccaacctttgagaatacttttgtgacgctggagaagtcgggcgcgatcctgactcgagtcataaatgtttttggcgcaatgacgtctgcccattccagcgatacgttgcggcaaatagatgaaaccacatcgccaaaactggcggcgttaaacgacgccatcatgctgaatagtaaactttttaagcgggtcaagaccgtttatcaccaacgggatactctcggccttgatgatgagtcacttcgcttggtgaacgtgatctatcacaacttcgtgctggctggagccaatctttctgatgcagataaaatccagcttaaagcgcttaatcaagaagcggccagcttgagcactcagtttactcatagattattggcggcgactaaagagggtgcgctagccatcaatgagaaagcggcgttggccggattatccaaagccgagttggccgcagcggcgcaggcagctcatgatcgacagttgggtcagcaatggctgttggtgttacaaaataccacccagcaaccagcattacagaatctgagcgatcgagacacacggaaagcactatttgatgcctcgtggaaccggacagagaaaggcgatgttcatgacacgcggaacatcatttctcgccaggcaaaaattcgcgccgaacaggctcagctattgggattcccgaactatgctgcttggaagctacaaaaccagatggcaaaaacgccagatgcggcactgagctttatgcgaaatattgttccggctgcgacggcgcgagcagagcgtgaagcgaaagatattcaggctgttatcgatcgacaaaaaggtggatttaaactcgggccagaggactggcagttctacgctgaacaggtgcgtaaggacaaatacgcattagatgaatcgcagattaaaccctattttgaattaaataatgtgttgaataatggggtgttttacgcagctaaccagctgtttggtatccgctttaaagaaagaaaggatttgccagtttatcatccagatgtgcgagtgtatgacgtgattgataacgatggtcaaccgctggcattattctataccgactactttaagcgtgataataaaggtggcggagcctggatgagtaattttgtcgatcaatctaagttattaggcagtaaacctgtgatttataacgtggctaattttagcaaaccagccaccggtcaacctgcattgttaacctatgatgaagttatcacgttattccatgaatttggtcatgccctgcatggctttttcgccaatcagcaatatccaagcctatctggaaccgctacggcacgtgattttgttgagtttccgtcgcagctaaatgaatactgggccagcgatacccaagtgttttcccattatgcgaaacattaccaaaccggcgaacctatgccaccggcattggtggataaaatccaaaaagccgataagttcaacaaaggctatagcatgacggagttgctgtcagccgccttgttggatatgcactggcatacgctaagtgctagccagccgccacaggatgttgatttatttgagagggaatcgctacggcgtgacaacatcgatctgagctatgcgccaccacgttatcgttccagctatttccagcatatttggggcaacggttatgccgccggttactatgcttatctttggacagaaatgctggctgatgatgcctttgaggggctgaaggaaaatggtggattaactcgtgaaaatggccagcgtttacgtgacaagatattgtcacgcggtaatagccaggatctggaaaaactgtatatcgactggcggggcaaggcacccgagattgaacctatgttgataaaccgtggtttaaaagagactaacccataa

SEQ ID NO: 2302 - DNA, 2163 bp, unknown
  environmental sample
atgcgtctttcaaacctctttttggctatcagtttggcatgcagctcgtacgtggcagtggcggagaccccttccacggcgacctcaaagcaggaaaatgtcatgaacagtcccgaacaaacggtaaaccctttctttgaacgcagcccgttgatttatcaggctccgcagttcgacaaatacaaagagagtgattacgccccggcgattgccgaaggtattaaacagaagctggctgaagtcgataaaattgctaatgacacggcgccgccaacctttgagaacacctacgtggcgctggagaaatccggcgtgctgctgacccgcgtattgagcgtgtttgatgcgatgacctcggccaataccactgacggcctgcagaaaattgatgaagagacctcgccaaaactggcagctatgtctgacagcattcatctcaacagcaagctgtttgatcgcctgaaaacggtttatgagcagcgtaactctttaaaattagatgctgaatcccagcgtctgattgaagtcacttataaagatttcgagctggcgggtgccaacctgtctgatgccgacaaagaaaaactcaaagccctgaaccagcaggcggcgacgctcagcactcaattcaccaataagctgctggcggccagcaaggcgggcgggctgacggtgaaagaccagaaacagctggccggtttgagcgaggccgagctttcagctgcgtctcaggcagcaaaagatcgcaagctgaccgacgcgtggctgctggtgttacagaacactacccagcagccgttgcttcagccgttggaagaccgcgacacccgcaaagcactctatgaggcgtcaattaatcgtgccgagcacggcgatgctaacgacacgcgccagctgatttccaagctggcgaaggtccgcgccgagcaggcgcagatcctgggtttcccttcttatgctgcctggaaattgcaaaaccagatggcgaaaacgccgcaggccgcgctcgacttcatgcataaaattgttccagccgctacggctcgcgctgaacgagaagcacaggacattcaggcgctaattgataagcaaaaaggcggcttcaagctggcggcatgggactggcagcactattccgagcaggtgcgcaaagagaaatatgacctcgacgacgcgcagatcaaaccctatttcgagctgaacaatgtgctggaaaacggcgtgttttatgctgccaacctgctctacggggtgactttcaaagagcgccatgacctgccggtttataaccctgacgtgcgggtgttcgaggtgttcgacaaagatggccaatccatggcgctgttctacgccgattattaccagcgcgataacaaaggcggtggtgcgtggatgagcaatttcgtcgatcagtccaagctgtttggcaccaagccggtgatctataacgtcgccaacttccaaaaaccggcagagggcaagcccgcgctgctgtcatgggacgacgtgatcaccatgttccacgagttcggccacgcgctgcacggcctgttcgccgaccagcagtatccaagtctctccggaaccgcgaccccgcgtgacttcgttgaattcccatcccagttcaacgagcactgggcgagtgatccgaaagtcttctctcacttcgccaagaattaccaaaccggcgaggccatgccgcaggcgctgcgcgacaaaatcgagaaagccagcaagttcaataaaggctatgagatgaccgagttgttggccgctgcgctgctcgatatgcactggcacagcctgagcgccagtgagccagagcaggacgtggataaattcgaagcggcttcgctgaaaaaagacaatatcgatctagcctatgtgccgccgcgctaccgttccagctacttccaacacatctggggcaatggctacgccgccggttattacgcctatctgtggaccgaaatgctggccgatgatgccttcgcgggtatcgaagagcagggcgggctgacccgcgaaaacggacagaagttccgtgaccaaatcctgtctcgcggcaacagcgaagaactcgaaaagctctatgaaacctggcgcggcaaggctccatccattgagccaatgctgataaatcgtgggttgaaggaggagtaa

SEQ ID NO: 2303 - DNA, 2160 bp, Rahnella sp.
atgcgtatttctcctctttttctggctattactttggcatgcagccaatacgcggtcggtgcagaacccacatctgcaccagcattaacgcaggagcacgtcatgaatcacgcaatcaatgcagataacccatttctgaaacccagcccgctggaatatcaggcaccgcaatttaatctctataaagacagcgattatgaaccggcgatcctcgaaggcatccgccagaaactggctgaagtcgataaaattgccagcgacagtgcaccgccaacctttgaaaatacctatgtggcgctggaaaaatccggcgtcatgctacaacgcgtacagaatgtttttggtgcgatgaccggtgcgaacaccaacgatacgctgcaaaaaattgacgaagatacctcgccaaaactggcggcgatggatgacagcattcatctcaacagcaagctgtttgcgcggctgaaagcggtctatgaccagcgcagcagcctgaaaatttccccggaatcacagcgcctgattgaggtaacttttaaggatttcgaactggcaggtgccaatctttctgatgccgataaagacaaactcagggcgctgaaccagcaggccgcgacgctcagcacgcagttcactaataaattgctggccgccaccaaagcgggcgggctgacggtgaaagataaagcgcagctcgccgggctgagtgatgccgaattatcggcagccgcgcaggccgccaaagatcgcaaactggataacgcctggctgctggtgctgcaaaacaccacccagcagccgttgttacagtcgctggatgaccgtgaagcgcgcaaggcgctgtatgaggcctcgatcaatcgcgctgaaaaaggcgatgccaatgacacccgcgaactgatcgcgaagctggcaaaagtgcgtgcggaacaggcccgtgtactgggcttcccgagctatgcggcatggaagctggaagaccagatggcgaaaacgcctaaggcggctctggatttcatgcataaaattgtcccggcagcgaccgcccgcgccgggcgtgaggccgctgacattcaggcagaaatcgataaacagaacggcggcttcaaagtggccgcctgggactggcagcattacgcgcagcaggtgcgcaaagagaaatatgatctggacgacgcgcagatcaaaccctatttcgagctgaataatgtgctggaaaacggtgtattttatgccgctaacctgctgtacggcatcacttttaaagaacgtaaagacctgccggtgtataaccctgatgtgcgggtttttgaagtattcgataaggacggcaaatcgatggcgttgttctacgccgattattatcagcgcgataataaaggcggtggcgcatggatgagcaattatgtcgatcagtcgaaactgctgggtaacaagccggtgatttataatgtggcgaatttccagaaaccggctgcggggcaaccggcgttgctgtcgtgggatgacgtgatcaccctgttccacgagtttggtcacacgctgcacggcctgtttgccgatcaggaatacccaggcctttccggtaccgcgacgccgcgtgattttgtcgaattcccgtcgcagtttaacgagcactgggcgagtgacccgaaagtgtttactcattttgcgaaacattataaaaccggtgaagtgatgccgcaggccttgcaggacaaaatcgagaaagccagcaagttcaacaaaggttatgacatgaccgaactgctggcggctgcgttactggatatgcactggcacagcctgggcgcggacgcaccgcagcaggatgtcgataagttcgaagcggagtcgctggcgaaagataaagtgaatctggcgtatgtgccgccgcgctaccgttccagctatttccagcacatctggggtaacggttatgcagcgggatattacgcttatctgtggaccgaaatgctggccgacgatgcctttgcgggcattaccgaacagggcgggctgacgcgggagaacggtcagaaattccgtgatcagatcctctcgcgcggcaacagcgaagatctcgaaaaactctatgaaacctggcgcggcaaagcaccgtcgattgagccgatgctgaaaaaccgcgggctggaggagtaa

SEQ ID NO: 2304 - DNA, 2061 bp, Ewingella sp.
atgaacagtcccgaacaaacggtaaaccctttctttgaacgtagcccgttgatttatcaggctccgcagttcgataaatataaagagagtgattacgccccggcgattgccgaaggtattaagcagaagctggctgaggtcgataaaatcgccaacgactcggctgcgccaacctttgagaacacctacgtggcgctggagaagtccggcgtgctactgacccgcgtgttgagcgtgtttgatgcgatgacctcgtcgaacaccaccgacggcttgcagaaaattgacgaagatacttcgccaaaactggccgccatgtccgacagcattcatctcaacagcaagctgtttgaccgcctgaaaacggtttatgagcagcgtaattccttaaaattagatgctgaatcccagcgtctgattgaagtcacttataaagatttcgagctggcgggtgccaacctgtctgatgccgacaaagaaaaactcaaagccttgaaccagcaggcggcgacgctcagcacccaattcaccaataagctgctggcggccagcaaggcgggcgggctgacggtgaaagaccaaaaacagttggccggtctgagtgaagccgagctttccgccgcgtctcaagcggcaaaagaccgcaagatgaccgacgcgtggctgctggtgttgcagaacaccacccagcagccgttgcttcagccactggaagaccgcgacacgcgcaaagccctgtatgaggcttcgataaatcgtgctgaacacggcgatgctaacgacacgcgccagctgatttccaagctggcgaaggtccgcgccgagcaggcgcagatcctgggtttcccttcttatgctgcttggaaattgcaaaaccagatggcgaaaacgccgcaggccgcgctcgatttcatgcataaaatcgtcccggcggccactgcccgcgctgagcgagaagcgcaggacattcaggctctgattgataagcaaaagggcggcttcaagctggcggcgtgggactggcagcactattccgagcaggtgcgtaaagagaaatatgaccttgacgacgcgcagatcaaaccctatttcgagctgaacaatgtgctggaaaacggcgtgttttatgccgcgaacctgctctacggggtgaccttcaaagagcgccacgacctgccggtttataacccggacgtgcgggtgttcgaggtgttcgacaaagacggccagtccatggcactgttctacgccgattactaccagcgagataacaaaggcggcggcgcgtggatgagcaacttcgtcgatcagtccaagctgctgggcaccaagccggtgatttataacgtcgcgaacttccaaaagccggcagagggcaagcccgcgctgctgtcatgggacgacgtgatcaccatgttccacgagttcggccacgcattgcacggcctgtttgccgaccagcagtacccgagtctctccggcaccgcgacgccgcgtgacttcgttgaattcccatcgcagttcaacgagcactgggcgagtgacccgaaagtcttctcccatttcgccaaaaattaccagaccggcgaagccatgccgcaggcgctgcgtgacaaaatcgagaaggccagcaagttcaacaaaggctacgatatgaccgagctgctggccgctgcgctgcttgatatgcactggcacagcctgagcgccaatgagcccgagcaggacgtggacaagttcgaagcggcctcgctgaagaaagataatatcgatctggcctacgtgccaccgcgctatcgttccagctacttccaacatatctggggcaatggatacgcggcgggttattacgcctatctgtggaccgaaatgctggctgatgacgccttcgcgggtatcgaagagcagggcgggctgacccgtgaaaacgggcagaagttccgtgaccaaatcctgtctcgcggcaacagcgaagatctcgaaaaactctatgaaacctggcgcggcaaagctccatctattgagccaatgctgataaatcgtgggttgaaagaggagtaa

SEQ ID NO: 2305 - DNA, 2184 bp, Rhodanobacter sp.
atgcttcgtctgcgcacgattgtgattgccaccacgatggccctggctgcctgctcgcagcagccgcacgaggccgctaacccacccgccccgaccgccccggccgccgccagcagcaccgccaccgccatgaccagcaacccgttctacagcgccagcacgctgccgttccaggcgccgccgttcgacaagatccacgacgccgattaccaaccggccatcgaggaaggcatgcgccagcaactggccgagatcgagaagatcgccaacgacccggccgcgcccacgttcgagaacacctacgtggcgatggagaaatccggcgcgatgctgcaccgggtgatggcggcattcaacgccgtcaccggcgccaacaccaacgacacgctgcagaaggtgcaggaacaggaagcgccgaagctggccgcgcacgaggacgcgatccacctcgacggcaagctgttccagcgcgtgcagacgatttacgaccagcgcgacacgctcaagctcgatccggaatccgcgcgcctggtcgaggtggtctacaagaacttcgtgcacgccggcgccaagctctccgatgccgacaaggcgaagctgaaagacctcaacaaggaagagtccacgctgagcaccgccttcaccaacaagctgctgaccgccaccaaggacgccgcgccggtgatcgccgacaaggcgcagctggccggcctgtccgacgccgagctggccgccgccgcgcaggccggcaaggagcgcaagcaggacggcaagtacgtgctgaccttgcagaacaccacccagcagccggagctgcaggatctcaccgaccgcgccacccgccaggcgctgttcgaagcctcgtggacccgtgccgagcggggcgacgcgaacgacacccgcaagaccatcgagcggctggcgcagatccgcgcggagcaggcgaagctgctcggttatcccgactacgccgcgtggaagctcgacgaccagatggcgaagacgccggaaacggcgctgaagttcatgcaggatctggtgcccgcggtcaccgcgcgcgcgaagaccgaggcaggcgacatccaggccgtgatcgaccagcagcacggcgatttcaagttggcgccgtgggactggaacttctacgccgagcaggtgcgcaaggcgaagttcgacctcgacgagaaccagatcaagccgtacttcgagctggacgacgtgctgcagaacggcgtgttctacgccgccaaccagctgtacgggctgaccttcaaggagcgccacgacatcccggtgtaccagccggacatgcgcgtattcgaggtgttcgaccaggacggcaagtcgctggcgctgttctacaccgactacttcaagcgcgacaacaagggcggcggcgcctggatggacaacctggtcacgcagtcgaaactgctcggcagcaagccggtgatcttcaacgtgtgcaacttcagcaagccggccgcgggtcagccggcgctgctgtcgttcgacgacgtgaccaccatgttccacgagttcggccatgcgctgcacggcatcttcgccgacgagcagtacccgaccctgtccggcaccaacaccgcgcgcgacttcgtcgagttcccctcgcagttcaacgagcactgggccaccgaccccaaggtgttcgcccactacgcgaagcactaccagaccggtgagccgatgccgcaggcgctggtcgacaagatgaagaaggccggcaagttcaacaagggctacgagatgaccgagctggtcgccgccgccctgctcgacatgaactggcacatgctcggcgccgacgcgccgctgcaggacgccgaccagttcgaggccgccgcgctgaagaaggacggcatcgacctcagctacgtgccgccgcgctaccgctccagctacttccagcacatctggggcaacggctacgccgccggctactacgcctacctgtggacgcagatgctggccgacgacgccttcatcggcttcaaggaacacggtggcctgacccgcgagaacggcgaccgcttccgcgcgatggtgctgtcgcgcggcaacaccgaggagctggcgaagatgtaccgcgactggcgcggccacgacccggagatcgagccgatgctggagaaccgcgggctgaaggacgcgccgaaaccgtaa

SEQ ID NO: 2306 - DNA, 1566 bp, Serratia sp.
atgagcttaatttatcgggcgttattctacgcctttgcggtgatactgtccttttttagcagcactgcggttgttgcgggccagctaatattgaaaaacatctctttatcgcccattacttgcacggttgacggttggacggtctcttcaggcagcagtttcgattggttcattaaggtgcagccggggcagtcattctttgttggacagaacaccagcaggccgaaagacccggtaattaattgggcaaagtgcaataacttgcatacccgcgcgatgaccataacgcccagcggccccaatcaaacgctggtgctgaatgggcaacaaacgcaagtattgaacgtctcgctttatccttttcttcctacgctacccacggataacttcgaaaatttggtcgcctatattgtgcagacttatcagtcgcagcacccgcaggtgttactcaatgcagtgctgaatccgcaggtgaatatttacagttttaccgagttgccggtcctgctgggtaatgatggatttgacgtgatagagcttgatgtcctttatctgggtttcctggcggataatcatctgatcaaccccgcccagattaccggcgaagcgccctgggccgtggcgctggcgggggcgacttaccaaggccagttatgggcgatccccagttggctctgcatggactttttctacgcgttcgatcaggcgattcagcagcagaaaaccttgtcgaaaatgctgaattatttgaatacccgaacgtcgtcagtcgccaaaatggcaggcagctttaatggcagttgggctattccttccgattatatcaacgcttatgtgcagacctatggttacggtgcgttgcaacaggcgatgcaaatgccgcctgataacggcgttgtccatcaattggtttcactgtctgatacctgcagctttaacggggtcaacaagtgtaccaataacacctatcataacgccccgaatggcggtgccgagcaggtgttcgcctccgggcaggccagtaccgacatgggcttttccgagcagtctttctacgtgaatctctattcgtcggcgcaaaaaccgctgtatgtcgtgcctaccccttggggagaacacccccaaccgctgttatttgaagacgcttttgtttccagcgccgcgacgtgcaagccgggcagccaatgtgcggccaatgcgcaagcgttcaccacgttaatgaccgggacggcgatgaaaaattatatcgtgcagtccaaagatctgcccgccggtacgccttggcggacgttgttggtggccactcagcaattctggcaacagtcgatcattgccaataacagttattaccaacagttatcgccgatatttatgacggcaaaggcgtttcctaacaactttaccccgcaaagccaggttgctatggccaatggcatttgcaatgccctaaaacagcagcagcctaattttgtttgtaaaagcaataatagcaccagcttgttagccccatctcacggcagttccatcatcaacccacgcagcactgatagcaggagaggtttatga

SEQ ID NO: 2307 - DNA, 1566 bp, Serratia sp.
atgaacttaatttatcgggcgttattctacgcctttgcagtgatgctgtccttttttagcagcactgcggttgttgccggccagctaatattgaaaaacacctctttatcgcccattacttgcacggttgacggttggacggtctcttcaggcagcagtttcgattggttcattaaggtgcaaccggggcagtcattctttgtcggacagaacaccagcaggccgaaagaccctgtaattaattgggcaaagtgcaataacctgcaaacccgcgcgatgaccataacgcccagcggccccaatcaaacgctggtgctgaatgggcaacaaacgcaagtattgaacgtctcgctttatccttttcttcctacgctacccacggataatttcgaaaatttggtcgcctatattgtgcagacttatcagtcgcagcacccgcaggtgttactcaatgccgtgctgaatccgcaggtgaatatttacagttttaccgagttgccggtcctgctgggtaatgatggatttgacgtgattgagcttgatgtcctttatctgggtttcctggcggataatcatctgatcaaccccgcccagattaccggcgaagcaccctgggccgtggcgctggcgggggcgacttaccagggccagttatgggcgatccccagttggctctgcatggactttttctacgcgttcgatcaggcgattcagcagcagaaaaccttgtcgaaaatgctgaattatttgaatacccgaacatcgtcagtcgccaaaatggcaggtagctttaatggcagttgggctattccttccgattatatcaacgcttatgtgcagacctatggttacggtgcgttgcaacaggcgatgcaaatgccgcctgataacggcgttgtccatcaattggtttcactgtctgatacctgcagctttaacggggtcaacaagtgcaccaataacacctatcataacgccccgaatggcggtgccgagcaggtgttcgcctccgggcaggccagtaccgacatgggcttttccgagcaatctttctacgtgaatctctattcgtcggcgcaaaaaccgctgtatgtcgtgcctaccccttggggagaacacccccaaccgctgttatttgaagatgcttttgtttccagcgccgcgacgtgcaagccgggcagccaatgtgcggccaatgcgcaagcgttcaccacgctaatgaccggcactgcgatgaaaaattatatcgtacagtccaaagatctgcccgccggtacgccgtggcggacgttgttggtggccacccagcaattctggcaacagccgatcattaccaataacagttattaccaacagctatcgtcgatatttatgacggcaaaggcgtttcctaataactttacggcacaaagccaggttgccatggccaatgacatttgcaatgccctaaaacagcagcaacctaattttgtttgtaaaagcaataatagcaccagcttgttagccccatctcacggcagttccatcatcaacccaggcaacactgatagcaggagaggtttatga

SEQ ID NO: 2308 - DNA, 1566 bp, Serratia sp.
atgaacttaatttatcgggcgttattctacgcctttgccttgatgctgtccttttttagcagcactgcggttattgccggccagctaatattgaaaaacacctctttatcgcccattacctgcacggttgacggctggacggtttcttcaggcagcagtttcgattggttcattaaggtgcagccggggcagtctttctttgttggacagaacaccagcaggccgaaagaccctgttattaattgggcaaaatgcaataacctgcaaacccgcgcgatgaccataacgcccagtggccccaatcaaacactggtgttgaatgggcaacaaacgcaagtattgaacgtctcgctttatccttttcttcctacgctgcccacggataacttcgaaaatttagtcgcctatgttgtgcagacttatcagtcgcagcatccgcaggtgttactcaatgcagtgctgaatccgcaggtgaatatttacagttttaccgagttgccggtcctgttgggtaatgatgggtttgacgtgatggaacttgatgtcctttatctggggtttctggcggataatcatctgatcaatcccgcccagattaccggtgaagcgccatgggccgtggcgctggcgggggcgacttaccaaggccagttatgggcgatccccagttggctctgcatggactttttctacgcgttcgatcaggcgattcagcagcagaaaaccttgtcgaaaatgctgaattatttgaatacccgaacgtcgtcagtcgccaaaatggcaggcagctttaatggcagttgggctattccttccgactatatcaacgcttatgtgcagacctatggttacggtgcgttgcaacaggcgatgcaaatgccgcctgataacggcgttgtccatcaattggtttcactgtctgatacctgcagctttaacggggtcaacaagtgcaccaataacacctatcataacgcccctaatggcggtgccgagcaggtgttcgcctccgggcaggccagcaccgacatgggcttttccgaacagtctttctacgtgaatctctattcgtcagcgcaaaaaccgctgtatgtcgtgcctaccccttggggagagcacccccaaccgctgttatttgaagatgctttcgttaccagcgccgcgacctgcaagccgggtagccaatgtgcgaccaatgcacaagcgttcaccacgctaatgaccggcactgcgatgaaaaattatatcgtgcagtccaaagatctgcccgtcggtacgccgtggcggacgttgttggtggccactcagcaattctggcaacagtcgatcattaccaataacggttattaccaacagttatcgtcgatatttatgacggcaaaggcgtttcctaataactttaccccgcaaagccaggttgctatggcaaatggcatttgcaatgccttaaaacagcagcagcctaattttgtttgtaaaagcaataatagcaccagcttgttagccccatctcacggcagttccatcatcaacccaggcagcactgatagcaggagaggtttatga

SEQ ID NO: 2309 - DNA, 1389 bp, Serratia sp.
gtgcagccggggcagtcattctttgtcggacagaacaccagcaggccgaaagacccggtaattaattgggcaaagtgcaataacttgcaaacccgcgcgatgaccataacgcccagcggccccaatcaaacgctggtgctgaacgggcaacaaacgcaagtattgaacgtctcgctttatccttttcttcctacgctgcccacggataacttcgaaaatttggtcgcctatattgtgcagacttatcagtcgcagcacccgcaggtgttactcaatgcagtgctgaatccgcaggtgaatatttacagttttaccgagttgccggtcctgttgggtaatgatggatttgacgtgatggagcttgatgtcctttatctgggtttcctggcggataatcatctgatcaaccccgcccagattaccggcgaagcgccctgggccgtggcgctggcgggggcgacttaccaaggccagttatgggcgatccccagttggctctgcatggactttttctacgcgttcgatcaggcgattcagcagcagaaaaccttgtcgaaaatgctgaattatttgaatacccgaacgtcgtcagtcgccaaaatggcaggcagctttaatggcagttgggctattccttctgattatatcaacgcttatgtgcagacctatggttacggtgcgttgcaacaggcgatgcaaatgccgcctgataacggcgttgtccatcaattggtttcactgtctgatacctgcagctttaacggggtcaacaagtgcaccaataacacctaccataacgccccgaatggcggtgccgagcaggtgttcgcctccgggcaggccagtaccgacatgggcttttccgagcagtctttctacgtgaatctctattcgtcggcgcaaaaaccgctgtatgtcgtgcctaccccttggggagaacacccccaaccgctgttatttgaagacgcttttgtttccagcgccgcgacgtgcaagccgggcagccaatgtgcggccaatgcgcaagcgttcaccacgttaatgaccgggacggcgatgaaaaattatatcgtgcagtccaaagatctgcccgccggtacgccgtggcggacgttgttggtggccactcagcaattctggcaacagtcgatcattgccaataacagttattaccaacagttatcgccgatatttatgacggcaaaggcgtttcctaacaactttaccccgcaaagccaggttgctatggccaatggcatttgcaatgccctaaaacagcagcagcctaattttgtttgtaaaagcaataatagcaccagcttgttagccccatctcacggcagttccatcatcaacccaggcagcactgatagcaggagaggtttatga

SEQ ID NO: 2310 - DNA, 1566 bp, Serratia sp.
atgggttttctatctcggatagtggtgcacacagtcgtcattggcatactagcattcggtaatgcagtcgcttttgccggacagttaatactaaaaaatatgtcctcaaaccctattacttgcactgttgacggctggactatctcatcaggtagcagcttcgattggtatattaaagtacaaccgggccagtccttttacgtaggtcagaataccagccgacccaattcccctattatcaactgggcaaactgcaataacctgcaaacacgctcaatgactgtgacgccatcgggtcctaatcagacactggtgcttaacgggcagcaaacacgggttctcaatgtatcgctttacccctacttgccaaccttgccgaccgatgattttgaaaatctggtcgcctatattgtacagacgtaccaggcacagcatccacaagtcttactcaatgccgtactcaaccaggcggtggacatctatagctttgacgcactgcctacattgctgggtcacgagggttttgatgttatagaacttgatgttttgtaccttgggtttctggctgacaaccatctgattaaccccgtacagattaccggtgatgcaccatggccagttgctctcgccggttcaacctataaatatcagttgtgggggataccaagctggttatgcatggattttatctacgattacaatcatgagatcacaacacagaaaagcctgacgcagttgataacctatctgggcactcgttcacctgacatcccagaacttgtaggcagctataatggcagttggagtattccttcagactacattaacgcctatgtgcaaacctatggcttcgaggcgctacagcaatcgatgcaaatgcccccagatgaggccgttgtaaagcaattagtcaccctgtctgatacctgtgaacataacggtatcaacaaatgcacgaataatacttatcaccatgccccaaatgggactaccgagcaggttttcgctaccgggcaagccagtaccgatatgggattctcagaacagtccttctttatacggctctatcagtcaacgcatgatccgctttatgttactcccacgccttggggagaaaagcctcagccgctcctgtttcaagatagtttcgtttccagtgcagcaacttgctcaccaggcagcaattgcgccgccgatgctcaggcgtttaccacactgatgaccagcgtagcgatgaaaaactacattgtacaatccaaagatctgccggctggtagcccgtggcgcacactattggttgccaatcaacaattctggcaacaacctctgattgccgataatgcttattaccagcagcttcaacccatatttgcaactgcacaggcatttcccaacaactttacagagcaggtacaaactgaaatggccactcaaatctgcactgctttaaaacaacaacaacctatgttcgtctgtgacagcggcaccaataccaccttgctggcaccatcacattcaaggctatcatcaccccaaaaaccagctcaaagcaggagaggattatga

SEQ ID NO: 2311 - DNA, 402 bp, Serratia sp.
atgagtattggacccgtttccggtaatggcatcaccatcaccttacccgtaggcaaaacgctattttggaccgccaatgtccaggcatcgtactcacaatatgttctggttcgcgactcgacgaatcaggtggttattgagagcaaaggtgcatcgacaggcgggcattcgccgacccaaattggccagggctcgtttgttaccgcaggcagcggggtttataccgttttcattggctataacaatggccagtcctggtcccaggttatgtgggatgaaatcgcgttaaatatcggcagccagatttactccagttgtttcaatttcattagtgaagacggcgcggatcgggatttcaatgatacctgcctgacactgacctggtttaacagcatcggttga

SEQ ID NO: 2312 - DNA, 339 bp, Serratia sp.
atggcaatcggtcactatgagctgaaaaaagcaaagaatgggcaataccacttcaacctgaaagccagcaatggcgagatcattctgggcagtgagatgtacgccagcaaagcctcggcggagaatggcattgcctcggtgcaaaccaattcgcctcaggaagggcagtatgaattgaaacacagcaccagcaatcaaccttactttgtactgaaagccaagaaccatcaggtgatcggcgtcagcgaaatgtacagttctgaaactgccgcgaaaaatggcattcagtcagtgatcaagaacggcccaagcaccgacgtgcgcgatttaagcgcatag

SEQ ID NO: 2313 - DNA, 339 bp, unknown
  environmental sample
atggcaatcggtcactatgagctgaaaaaagcaaagaatgggcaataccacttcaacctgaaagccagcaatggcgaaatcattctggccagcgagatgtacgccagcaaggcctcggcggagaatggcattgcctcggtgcaaaccaattccccccacgaagcacagtacgaactcaagcacagcaccagcaatcagccttatttcgtgctgaaagccaaaaaccatcaggtgatcggcgtcagtgagatgtacagctctgaaactgcggcaaagaacggtattcagtcggtgatcaaaaacggtccagccaccgacgtgcgcgatctgagcgcgtaa

SEQ ID NO: 2314 - DNA, 339 bp, Serratia sp.
atggcaatcggtcactatgagctgaaaaaagcaaagaatggacagtaccacttcaacctgaaagccagtaatggcgaaatcattctggccagtgagatgtacgccagcaaggcctcggcggagaatggcattgcctcggtgcaaaccaattctccccacgaagcgcaatatgaaatcaagcacagcaccagcaatcagccttactttgtgctgaaggccaaaaaccatcaggtgatcggcgtcagcgaaatgtacagctctgaaactgctgcaaaaaacggcattcaatcggtaatcaaaaacggcccgaacaccgacgtgcgcgatttgagcgcataa

SEQ ID NO: 2315 - DNA, 339 bp, Serratia sp.
atggcaaacggtcactatgagctgaaaaaagcaaagaatggacagtatcacttcaacctgaaagccagtaatggcgaaatcattctggccagtgagatgtacgccagcaaggcctcggcggagaatggcattgcctcggtgcaaaccaattctccccacgaagcgcaatatgaaatcaagcacagcaccagcaatcagccttactttgtgctgaaagccaaaaaccatcaggtgatcggcgtcagcgaaatgtacagctctgaaactgctgcaaaaaacggcattcagtcggtaatcaaaaacggcccgaacaccgacgtgcgcgatttgagcgcataa

SEQ ID NO: 2316 - DNA, 339 bp, Serratia sp.
atggcaatcggtcattacgagctgaaaaaagcaaagaacggacagtaccacttcaacctgaaagccagtaacggcgagatcattctggccagcgagatgtatgccagcaaagcctcggcggagaacggcatcgcctcggtgcagaccaattcaccgcacgaagcgcagtacgaactgaagcacagcgccagcaatcagccctactttgtgctgaaggccaagaaccatcaggtgatcggcgtcagcgaaatgtacagctccgaaagcgcggccaaaaacggtatccagtcggtgataaaaaacggcccgaccaccgatatccgcgatttgagcgcctga

SEQ ID NO: 2317 - DNA, 339 bp, Serratia sp.
atggcaatcggtcattacgagctgaaaaaagcaaagaacggacagtaccacttcaacctgaaagccagtaacggcgagatcattctggccagcgagatgtatgccagcaaagcctcggcggagaacggcatcgcctcggtgcagaccaattcaccgcacgaagcgcagtacgaactgaagcacagcgccagcaatcagccctattttgtgctgaaggccaagaaccatcaggtgatcggcgtcagcgaaatgtacagctccgaaagcgcggccaaaaacggtatccagtcggtgacgaaaaacggcccgaccaccgacatccgcgatttgagcgcctga

SEQ ID NO: 2318 - DNA, 339 bp, Serratia sp.
atggcaatcggtcattacgagctgaaaaaagcaaagaacggacagtaccacttcaacctgaaagccagtaacggcgagatcattctggccagcgagatgtatgccagcaaagcgtcggcggagaacggcatcgcctcggtgcagaccaatgcgccgcacgaagcgcagtttgaactgaagcacagcaccagcaatcagccctattttgtgctgaaggccaagaaccatcaggtgatcggcgtcagcgaaatgtacagctccgaaagcgcagccaaaaacggtatccagtcggtgatgaaaaacggcccgaccaccgatatccgcgatttgagcgcctga

SEQ ID NO: 2319 - DNA, 339 bp, Serratia sp.
atggccatcggtcattacgagctgaaaaaagcaaagaacggacagtaccacttcaacctgaaagccagtaacggcgagatcattctggtcagcgagatgtacgccagcaaagcctcggcggagaacggcatcgcctcggtgcagaccaattcgccgcacgaagcgcaatttgaactgaagcacagcaccagcaatcagccctattttgtgctgaaggccaagaaccatcaggtgatcggcgtcagcgaaatgtacagcaccgaaagcgcggccaaacacggcatccagtcggtgatgaaaaacggcccgaccatcgatatccgcgatttgagcgcctga

SEQ ID NO: 2320 - DNA, 339 bp, Serratia sp.
atggcaaccggacattatgaactgacaaaatcgagcaacgggcagtatcacttcaacctgaaagccagcaacggcgagatcattctctccagcgagatgtatgccagcaaagcctcggcggaaaacggtatcgcctccgtgcagatcaattcgccccacgaggcgcagtttgaaatgaaaaccagcagcaataacaaaccctatttcgtgttaaaagccaaaaaccatcaggtgattggtaccagccagatgtacagttcggaaagcgcggcgaaaaacggcattcagtcggtgattaaaaatggccccactaccgacgtgcgagacttgagtgcctga

SEQ ID NO: 2321 - DNA, 339 bp, Serratia sp.
atggcgaacggtcactatgagctaaagaaatcgagtaacgggcagtatcacttcagcctgaaagccagcaacggggagattattctttccagtgagatgtatgccagcaaggcgtcggcggaaaacggtattgcctccgtgcagaccaattcgccccatgaggcgcaatttgaagtgaaagtcagcagcaacaacaaaccctattttgtattgaaagccaaaaaccatcaggtgattggcaccagccagatgtacagttcggaaagcgcggcgaaaaacggcgtccagtcggtaatcaaaaacggtcctaccactgatgtgcgtgatttgagcgtctga

SEQ ID NO: 2322 - DNA, 339 bp, Serratia sp.
atggcaagcggacattatgagctgacaaaatcgagcaacgggcaatatcacttcaacctgaaggccagcaatggcgagatcattctctccagcgagatgtatgccagcaaagcctcggcggaaaacgggattgcgtccgtgcaaaccaattcgcctcatgaggcgcagtttgaagtgaaaatcagcagcaacaacaaaccctatttcgtgctgaaagccaaaaaccatcaggtgattggcaccagccagatgtacagctcggatagcgcagcgaaaggcgggattcagtcggtgatcaagaatggcccaaccacagacgtgcgtgatttaagcgtataa

SEQ ID NO: 2323 - DNA, 339 bp, Yersinia sp.
atggccacgggtcactatgagattaagaaggcaaagaatgggcagtatcatttcaatctgaaagccagtaatggcgaaatcattctcaccagtgagatgtatgccagtaaagcctcggcggaaaatggcatatcatcggtgcaaagtaactccccactggaaagccaatatgagctgaaacacaacaccaaaaatgagccttattttgtgttgaaagcgaaaaaccatcagattattggtgttagtgagtcctacagttccgaagctgccgctaaaaatggtattgcctcagtgataaaaaatggcccgactaccattattaaagatctaacgctgtaa

SEQ ID NO: 2324 - DNA, 345 bp, Serratia sp.
atggcaaacggccactatgaattaaaaaaatccagcagcaacggacagtttcacttcacgttaaaggccagcaacggcgaaattattctttccagtgagatgtacaccagcaaggcgtcggcggaaaacggcatcgcctcggtgcagaccaactctccgcatgaagcgcagtatgaaagcaaagtcagcagcaacggcaagccctacttcgtgctgaaggccaagaaccatcaggtgatcggcaccagccagatgtacagctccgacagtgccgcgaaaaacggcattcagtcggtgattaaaaacggcccgaccaccgacgtgcgcgatctcagcgccggctga

SEQ ID NO: 2325 - DNA, 339 bp, Yersinia sp.
atggccacgggtcactatgagattaagaaggcaaagaatgggcagtatcatttcaatctgaaagccagtaatggcgaaatcattctcaccagtgagatgtatgccagtaaagcctcggcggaaaatggcatatcatcggtgcaaagtaactccccactggaaagccaatatgagctgaaacacaacaccaaaaatgagccttattttgtgttgaaagcgaaaaaccatcagattattggtgttagtgagtcctacagttccgaagctgccgctaaaaatggtattgcctcagtgatgaaaaatggcccgactaccattattaaagatctaacgctgtaa

SEQ ID NO: 2326 - DNA, 342 bp, Hafnia sp.
atggcaatcggctattacgaaattaaaaaagcgaagaacggacagttccactttaatctgaaagcaagcaatggtgagattattctctccagcgagatgtatgccagcaaggcatccgccgataacggcatcgcctcagtgcaggctaattcacccgacgaagcacagtttgagataaaaaatagcagcagcgatcaaccctattttgttctcaaagcgaaaaaccatcaggtgattggcactagcgaaatgtatagctctgaaagcgccgccaagaaagggattcagtcggtagtgaaaaacggtgcgacaacagatattagggatttgacgcacggttga

SEQ ID NO: 2327 - DNA, 339 bp, Yersinia sp.
atggccacgggtcactatgagattaagaaggcaaagaatgggcagtatcatttcaatctgaaagccagtaatggcgaaatcattctcaccagtgagatgtatgccagtaaagcctcggcggaaaatggcatatcatcggtgcaaagtaactcgccactggaaagccaatatgagctgaaacacaacaccaaaaatgagccttattttgtgttgaaagcgaaaaaccatcagattattggtgttagtgagtcctacagttccgaagctgccgctaaaaatggtattgcctcagcgatgaaaaatggcccgactaccattattaaagatctaacgctgtaa

SEQ ID NO: 2328 - DNA, 339 bp, Yersinia sp.
atggccatgggtcactatgagattaaaaaggcaaagaatgggcaataccatttcaatctgaaagccagcaatggtgaaattattctctccagtgagatgtatgccagtaaagcctccgcagagaacggcatcgcatcagtacagagtaactcgccactagagagccagtacgagtctaaacgtaatgtcaaaaacgagccatatttcgttttgaaagcgaagaaccatcaagttattggtgtcagcgaagcctacagttccgaagctgccgctaaaaatggcattgcctcagtgatgaaaaatggcccgacagcaacaataaaagatttgacgctgtaa

SEQ ID NO: 2329 - DNA, 339 bp, Yersinia sp.
atggccacgggtcactatgagattaagaaggcaaagaatgggcagtatcatttcaatctaaaagccagtaatggtgaaattattctctccagtgagatgtacgccagcaaagcatcggctgaaaatggcatctcatcggtacaaagtaattcgccattggaaagccagtttgaactgaagcgcaacgtcaaaaacgaaccttacttcgtgttgaaagcgaaaaaccatcaaattattggcgtcagcgaatcctacagttctgagtctgccgccaaaaatggcattgcctctgtaatgaaaaatggcccgaccactacaattaaagatctgacgctgtaa

SEQ ID NO: 2330 - DNA, 342 bp, Enterobacteriaceae sp.
atggcaagcgggcattacgatctaaaaaaatccaccaatgggcagcagtttcacttcaatttagttgccagcaacggtgagattattctgagcagtgaaatgtacaacagcaaggcctcagcagaaaacggcattgcgtctgtacagaccaactccccgtccgaagcgcaatatgagctgaagcaaagcaccaacggcaaaccttactttgtcttgaaggcgaaaaatcatcagattatcggtcagagccaaatgtacagcgctgaagcttctgctaaaaacggtattcagtcagtgatgaagaatggcccgacgacggatattcgtgatttaactcagtaa

SEQ ID NO: 2331 - DNA, 339 bp, Rahnella sp.
atggctactggtcactatgatctgaaaaaagcgaagaatggacagtttcactttaacctgaaggccgggaacggagagattattctcaccagcgaaatgtatgccagtaaagcgtcagcagaaaacgggatttcatcggttcagaccaactcccctgaggaagcgcagtacgaaatcaaaccttcgaaagacggtcagttttactttgtactgaaagcgaaaaaccatcaggtgattggtatcagcgaaatgtacaccacggaaagtgcatcgaaaaaaggtgttcagtcggtggtgaaaaacggcgcaagcactgatattcgcgatttgacgcaatag

SEQ ID NO: 2332 - DNA, 339 bp, Ewingella sp.
atggctaccggtcactacgagctcaagaaagccaagaatggacagttccactttaatttaaaggcgggcaatggcgagatcattctcaccagcgaaatgtacgccagcaaagcctctgccgagaacggcatcgcctcggtgcagactaactccccggatgagaagcagtacgaagtgaaaccggcaaaagacggtcagcactattttgtcctcaaggcgaaaaaccaccagatcattggcgtcagcgaaatgtacaccactgacgcggcggcgcgtaaaggcattgcctccgtcactaaaaacggcccgaccacggatatccgtgatttgaccagctag

SEQ ID NO: 2333 - DNA, 348 bp, Rahnella sp.
atggctaatggtcactatgatctgaaaaaagcgaagaatggacagtttcactttaacctgaaggccgggaacggagagattatcctcaccagtgaaatgtatgccagcaaagcctcggccgaaaacggcatttcatcggttcaaaccaacgcacctgacgaagcgcagtacgaagtcaaaccctcgaaagacggccagttctactttgtgctgaaagcaaaaaatcatcaggtgatcggcgtgagcgaaatgtactccacggaaagtgcatcgaagaaaggcgttcagtcggtcgtgaaaaacggtaccagtaccgatatccgtgatcttacccagcaaaccgcctga

SEQ ID NO: 2334 - DNA, 348 bp, Rahnella sp.
atggctaatggtcactatgatctgaaaaaagcgaagaatggacagtttcactttaacctgaaggccgggaacggagagattatcctcaccagtgaaatgtatgccagcaaagcctcggccgaaaacggcatttcatcggttcaaaccaacgcacctgacgaagcgcagtacgaagtcaaaccctcgaaagacggccagttctactttgtgctgaaagcaaaaaatcatcaggtgatcggcgtgagcgaaatgtactccacggaaagtgcatcgaagaaaggcgttcagtcggtcgtgaaacacggtaccagtaccgatatccgtgatcttacccagcaaaccgcctga

SEQ ID NO: 2335 - DNA, 384 bp, Yersinia sp.
ttgactacactcattagaggtatcacatgcaacaggagaaacactatggccttgggtcactatgagattaagaaagcaaaaaatgggcaatatcatttcaatctgaaggccagtaatggtgaaattattctctccagtgagatgtacgccagtaaggcctcagcggaaaatggcatcgcatcagtacaaagcaactccccgcaagaaagccagtacgagcttaaacacaacacaaaaaatgagccttatttcgttttgaaagcgaaaaaccatcaagttattggcgtcagtgaatcctacagttccccaaccgccgccaagaatggtattgcctccgtcatgaaaaatggcctgtctacggttatcaaagatttgacgctgtaa

SEQ ID NO: 2336 - DNA, 348 bp, Candidatus sp.
atggttaacggttactatgaaattaaaaaagcgaaaaacgggcaatattattttaatttaaaagcaggcaaccacgagattattttgacgagtgagatgtatgttagtaaagcctcggcagaaaatggtattgcttcggtacaaaccaattcccccgatgagaagcaatatgaaatgaagcttaatgttagaaatgaaccttatttcttattgaaagctaaaaatcatcaagtcattggtaagagcgaattttacagttctgatgcggcagcccaaaaggggatagcttctgttagccgtaatggcaagacaacggatgtgcgcgatcttagcgataaggaactgtga

SEQ ID NO: 2337 - DNA, 360 bp, Serratia sp.
atggctacgggtcactatgatcttaaaaaagcgaaaaacggacaatttcactttaacctgaaggccgggaacggagagattattcttagcagtgaaatgtacgccagtaaggcgtcggctgagaacgggattacttcggtacaaattaacgctaccgacgaaggacaatatgaaatcaagcccggaaaagagggacaacagtactttgtgctgcgggcgaaaaatcatcaagtcatcggcgttagcgaaatgtacacggccacaagcggtcttcagaaaggtatgctgtcagttgtcaaaaatggaccgagtacggacattcgcgacctgactcacgcagactctctgacacgaatttga

SEQ ID NO: 2338 - DNA, 339 bp, Serratia sp.
atggcaacgggtcactatgagcttaaaaaatcgagtaaaggactgtaccatttcattctaaaagccagtaacggagaggttattctttccagtgagatgtatgcaagcaaagcgtcagcggagaacggtattgtttctgtacaatccaatgctccgcatgaagctcagtttgaagtgaagatcagcagttgtaacagaccttattttgtgctgagagccaaaaaccatcaggtcatcggcaccagccagatattcagttcagaaagcgcggcgaaaaacggcgttcggtccgtgatcaaacatggctcaaccccacatgtgcgtgatgtgaatgcctag

SEQ ID NO: 2339 - DNA, 348 bp, Candidatus sp.
atgattaacggttactatgaaattaaaaaagcgaaaaacgggcaatattattttaatttaaaagcaggcaaccacgagattattttgacgagtgagatgtatgttagtaaagcctcggcagaaaatggtattgcttcggtacaaaccaattcccccgatgagaagcaatatgaagtgaagcttaatgttagaaatgaaccttatttcttattgaaagctaaaaatcatcaagtcattggtaagagcgaattttacaattctgatgcggcagcccaaaaggggatcgcttctgttagtcgtaatggcaagacaacggatgtgcgcgatcttagcgataaggaactgtga

SEQ ID NO: 2340 - DNA, 345 bp, gamma sp.
atggcgacgggtcactatgatcttaaaaaagcgaagaacggacagtttcactttaacctgaaggccggtaacggagaagttatccttagcagcgaaatgtacgccagcaaagcgtctgctgagaatggaattacttctgtgcaaatcaatgccgccgacgaaggacaatatgagatcaagcccagtaaagacgggcagcactattttgtgctgcgggcaaaaaatcatcaggtcattggcgtcagtgaaatgtacacagctgcaagtgctgctcaaaagggcatgaagtcggtagtccaaaatggtccgagtacggatattcgcgatctgacgactcatcactag

SEQ ID NO: 2341 - DNA, 480 bp, Serratia sp.
atgaaaggcgataaaaagatcattgctcatctcaacaaactgctcggcaacgagctggttgccatcaatcaatatttcctgcacgcccgaatgttcaagaactggggcttaatgcgccttaatgataaggaatatcacgagtcgatcgacgaaatgaagcatgccgatcgctacatcgagcgcattctgtttcttgaaggcctgccgaatctacaagatcttggcaaactgaatattggcgaagatatcgaagaaatactgcgttcagacctggccctggagttggatggcgccaagaatctgcgtgaagctatcgcctatgccgactcgattcatgactatgtcagccgcgatttgatgatagaaattctggcggatgaagaagggcatatcgactggctggaaactgagctggatttgattgcgcgtctgggtatccagaattacgcgcaagcccaaatactggaacgcaaagactag

SEQ ID NO: 2342 - DNA, 480 bp, Serratia sp.
atgaaaggcgataaaaagatcattgctcacctcaacaagctgctcggtaacgagctggttgccatcaatcaatacttcctgcacgcgcgtatgttcaaaaattggggcctgatgcgtctcaatgaaaaggaatatcacgagtcgatcgatgagatgaaacacgccgatcgttatatcgagcgtatcctattcctcgaaggattaccgaacctgcaagatctcggcaagttgaatatcggcgaagatgtcgaagagatgctgaggtccgatttggctctggagttggatggagccaaaaacctgcgggaagccatcgcctatgccgactctatccatgattacgtcagccgcgatctgatgaaagagattttggccgatgaagaagggcacatcgactggctggaaaccgagctgagcctgatcgaacgcttgggcatccaaaactattcccaggcgcaggtgctggaacgcaaagactga

SEQ ID NO: 2343 - DNA, 480 bp, Serratia sp.
atgaaaggcgataaaaagatcattgctcacctcaacaagctgctcggtaacgagctggttgccatcaatcaatacttcctgcacgcgcgtatgttcaaaaattggggcctgatgcgtctcaatgagaaggaatatcacgagtcgatcgatgagatgaaacatgccgatcgctacatcgagcgtattctgttccttgaagggctaccgaacctgcaagatcttggcaagctgaatatcggcgaagatgtcgaagagatgctgaggtccgatttggctctggaactggatggtgccaagaacctacgggaaggtatcgcctatgccgactctatccatgattacgtcagccgcgatctgatgaaagaggtgttggccgatgaggaagggcatatcgactggttggagactgagctgagcctgatcgagcggcttggcatccaaaactattgccaggcgcaagtgctggaacgtaaagactga

SEQ ID NO: 2344 - DNA, 480 bp, Serratia sp.
atgaaaggcgataaaaagatcattgctcacctcaacaagctgctcggtaacgagctggttgccatcaatcaatacttcctgcacgcgcgtatgttcaaaaattggggcctgatgcgtctcaatgagaaggaatatcacgagtcgatcgatgagatgaaacatgccgatcgctacatcgagcgtatcctgttccttgaagggttaccgaacctgcaagatctcggcaagctgaatatcggcgaagatgtcgaagagatgctgaggtccgatttgaccctggagctggacggcgccaagaacctgcgggaaggtatcgcctatgccgactctatccatgattatgtcagccgcgatctgatgaaagaagtcttggccgatgaggaagggcatatcgactggttggagactgaactgagcttgattgagcggcttggcatccaaaactattgccaggcgcaagtgctggaacgcaaagactga

SEQ ID NO: 2345 - DNA, 480 bp, Serratia sp.
atgaaaggcgataaaaaactcattgctcacctcaacaaactgctcggcaacgagctggttgctattaatcaatacttcctgcatgcgcgaatgttcaaaaactggggcttaatgcgccttaatgacaaggaatatcgcgagtcgatcgacgagatgaagcatgccgatcgttatatcgagcgtattttgttccttgagggaataccgaacctgcaagatctcggcaagctaaatattggtgaagatatcgaagagatgttgaggtccgatttggctctggaattggaaggggctaagaatctgcgggaaggtatcgcgtatgcagattctattcatgattatgtcagccgtgatttgatgaaggatgtcctggctgatgaagaagggcacattgattggctggaaactgaattaagtctgattgaacggcttggtattcaaaactatgcccaagctcagttgctggaacgtaaagactga

SEQ ID NO: 2346 - DNA, 465 bp, Serratia sp.
atgaaaggcgataaaaagatcattgctcacctcaacaaactgctcggcaacgagctggttgccatcaatcaatatttcctgcatgcccgaatgttcaagaactggggtttaactcgcctcaatgataaggaataccacgagtcgatcgacgaaatgaagcatgccgatcgttacatcgaacgtattttgtttttggaaggtatcccgaacttgcaggacctcggcaagttaaatattggcgaagatattgaagaaatgttgcgttcagatctgactctggagttggacggtgccaaggggctgcgtgaagctatagcttacgccgattccatccatgactacgtcagccgtgatttgatgatagagatcctggcagatgaggaagagcatatcgactggctggaaacagaacttgatttgatcgaccgcctgggtattcagaactacgcacaagcccaactttag

SEQ ID NO: 2347 - DNA, 474 bp, Pectobacterium sp.
atgaaaggcgataaaaaagtcatcacacacctgaataagttattgggcaacgagctggtagctattaaccaatattttcttcatgcccgaatgtttaaaaactggggcttaacccgtcttaacgatcacgaatatcatgagtctattgacgaaatgaagcacgctgatcgctacatcgaacgaatcttgtttctcgaaggtatcccgaatctacaggatttgggtaaattaaatattggcgaagatgtcgaagaagtcttacgttctgatcttcaacttgagttagatggcgcaaagaatctgcgtgaggcgattgcctattctgattcggtgcatgactacgtcagtagggatctaatgatagagattcttgccgatgaagaagggcacattgactggttggaaactgaattagatttgattgcgcgtcttggtatacaaaactatcttcaggctcagctaaaagctgagtaa

SEQ ID NO: 2348 - DNA, 477 bp, Hafnia sp.
atgaaaggcgataaaaaagtcattactcatctcaataagctacttggtaacgagctagttgctatcaatcagtatttccttcacgcacgcatgttcaaaaactggggactcactcgtctcaatgacgttgaatatcatgagtccattgatgaaatgaaacatgcagatcgctatatcgaaaggattttatttttagagggactgccaaatctgcaagatcttggcaaacttaacattggcgaagatgttgaggagatgctccgatctgatttaaaacttgagttagacggcgctaaaaatttgcgtgaagggatcgcctactgtgattctgttcatgattacgtaagccgtgatttaatgatcgatattctttctgatgaagaaaagcatatcgactggcttgagaccgaactcgatcttatccagcgtcttgggattcaaaattatctgttggcgcaagtgaaagaagaagcctaa

SEQ ID NO: 2349 - DNA, 474 bp, Dickeya sp.
atgaaaggcgataagaaagtcattgcacatctgaacaaactgttgggtaacgaactggttgcaatcaaccagtatttccttcatgcccgcatgttcaaaaactggggactcaaacgtcttaacgatcatgagtatcatgagtcgattgacgaaatgaaacacgcggatcgttatatcgagcgtatcctttttctggaaggtgtccctaatctgcaggatcttggcaaactcaatatcggcgaagacatcgaagagatgctgcgttcagacctggcgctggaacttgaaggcgcaagggatttacgcgaggctatctcctatgccgactcggtgagggattatgtcagtcgtgatctgatgattgaggtgctcgctgatgaagaagagcacattgactggctggaaaccgaactggagctgattgcgcgtctgggtatccaaaactacctgcaaacgcaattgaaagaagagtga

SEQ ID NO: 2350 - DNA, 474 bp, Dickeya sp.
atgaaaggcgataaaaatgtcattacacatctgaacaaactgttgggtaacgagctggttgcaatcaaccagtatttccttcatgcccgcatgttcaaaaactggggactcaaacgtcttaacgatcatgagtatcatgagtcgattgacgaaatgaaacacgcggatcgttatatcgagcgtatcctttttctggaaggtgtccctaatctgcaggatcttggcaaactcaatatcggcgaagacatcgaagagatgctgcgttcagacctggcgctggaacttgaaggtgcgagggatttacgcgaggcgatctcctatgccgactcggtgagggattatgtcagtcgcgatctgatgattgaggtgctcgctgatgaagaagagcacatcgactggctggaaactgaactggaactgattgcgcgtctgggtatccaaaactacctgcaaacgcaattgaaagaagagtga

SEQ ID NO: 2351 - DNA, 477 bp, Enterobacter sp.
atgaaaggtgatgttaaggtcataaattatctcaataaattattgggaaatgagcttgtcgcgataaaccagtactttctccatgcgagaatgtttaagaactggggcctgatgcgcctcaacgatgttgaatatcacgaatccattgatgaaatgaagcacgccgataaatacatcgagcgtattctgtttcttgaggggattcccaatctgcaggatctcggtaagctcgggattggcgaagatgtcgaagagatgctgcgttccgatctggcgctagagctggatggggcaaagaacctgcgtgaagcgatcgcctatgctgacagcgtgcatgactacgtcagccgtgacatgatgatcgaaattctgaaggatgaagaagggcacatcgactggcttgaaaccgagctggatctgataggtaaaatcggcctgcaaaactacctccagtcgcaaattaaagtggaagaataa

SEQ ID NO: 2352 - DNA, 477 bp, Achromobacter sp.
atgaaaggtgatgttaaaatcataagttatctcaataaattattgggaaatgagcttgtcgcaatcaatcagtattttctccatgcgagaatgtttaaaaactggggcctcatgcgcctcaacgacgttgagtatcacgaatccatcgatgagatgaaacatgccgataaatatatcgagcgtattttatttctcgaaggcatccccaacctgcaggacctcggtaaactcggcatcggtgaagatgttgaagagatgctgcgatccgatctcagacttgaacttgaaggcgcaaaagaccttcgcgaagctattgcctacgcagacagtgtccatgactacgttagccgcgatatgatgatccagattctggccgatgaagaagggcatatcgactggctggaaaccgagctggatctcattggcaaaattggcctgcaaaactatctccagtcgcagattaaagtggaagattaa

SEQ ID NO: 2353 - DNA, 477 bp, unknown
  environmental sample
atgaaaggtgatattaagataataaattatctcaataaattattgggaaacgagctggtcgcgatcaatcagtattttctgcatgcgagaatgttcaaaaactgggggctgatgcgcctcaatgatgttgaataccatgaatccatcgatgaaatgaagcatgccgataagtacatcgagcgtattttatttcttgagggcattccaaacctgcaggatttgggcaaacttcatattggtgaagacgtagaagagatgctgcgttcagatctgaatctcgaaatggaaggggcgaaagatctgcgcgaggcaattgcttatgcagataccatccatgactacgttagtcgcgatatgatgattcaaatcctcgcggatgaagagcatcacattgactggctggaaaccgagcttgatctgatctcgaagattggtttgcagaattatatccagtcgcagattaaagaagaaagctaa

SEQ ID NO: 2354 - DNA, 492 bp, Serratia sp.
atgaaaggcgataccaaaatgatttcgcacctcaacaagctgctaggaaatgagctcgttgccatcaatcagtattttctccacgccagaatgttcaaaaattggggtttaatgcggctcaatggcattgaataccacgaatccatcgatgaaatgaaacacgctgatatctatatcgagcgtatcctattccttgaaggcatccctaatctgcaagatctcggcaaactcaatatcggcgaagacgttgaggaaatgcttaagtccgatctggtgctcgagctcgacggcgctaaggatttgcgtgaggccatcgcttatgccgattcaatccacgactatgttagccgcgatatcatgatcactattctggccgatgaagaacatcacattgactggattgaaaccgaagtcgatctgattagccgagttggtatccagaactacatccagacccagattaaagaagaatctaaaaaagcgtcacattag

SEQ ID NO: 2355 - DNA, 477 bp, unknown
  environmental sample
atgaaaggtgatgttaagattataaattatctcaataaattattgggaaatgagcttgtcgcaataaaccaatactttctccacgcgagaatgttcaaaaactggggcctgatgcgcctcaatgatattgaatatcacgaatccattgacgaaatgaagcacgccgatttgtacatcgagcgaattcttttccttgaagggatccccaacctgcaggacctcggcaaattacacatcggcgaagatgttgaagagatgctgcaatccgacctcaagctagaattagacggtgctaaagatttgcgggaagccatcgcctacgccgatagcgttcacgactacgtaagccgagacatgctgataacaatcctcaccgaggaagagcatcatatcgattggctggaaaccgaactcgaacttattagcaaaattggtctgcagaattacctgcaatcacagattaaagtcgcagactaa

SEQ ID NO: 2356 - DNA, 474 bp, unknown
  environmental sample
atgaagggcgatgccaaaattataagtcatttaaacaaattgcttggaaatgagctggttgctattaatcagtatttcctgcatgcgcggatgttcaagaattggggactgatgcggcttaacgatattgagtaccacgaatccatcgatgagatgaagcatgccgacaagtacattgaacgcattctgtttcttgaaggattacccaacctgcaggatctgggcagacttcgcatcggagaggatgttgaagagatgctgaagtcagatttagcgttggaacttgaaggggcgagagatttgcgggaagcgatagcctacgccgacaaggtgcatgattatgtcagtcgggacatgatgattgtgatcctggaggatgaagagcatcacatcgatttcctggaaaccgaacttgagctgatgggtaaggtcggggtacaaaattatctacagacacaaataaaagtcgaatag

SEQ ID NO: 2357 - DNA, 498 bp, Cronobacter sp.
gtggaagcggagggaagcaaaatgaaaggtgatatcaagataataaattatctcaataaattattgggaaacgagctagtcgcaatcaatcagtactttctccatgcgagaatgttcaaaaactggggcctgatgcgcctcaacgatgttgagtatcatgagtccattgatgagatgaagcacgctgatatctatatcgagcgcattctctttcttgagggtatccccaacctgcaggacctgggcaagttacatataggcgaagacgtagaagaaatgctgcgctccgatctcacgcttgagatggaaggggcaaaagacctgcgtgaagcgatcgcctatgccgactctattcatgactacgtcagccgggatatcatgatcaaaatcctggaagatgaagagcaccatatcgactggctggaaaccgagctggatcttatcggtaaaattggtctgcagaattacattcagtcccagattaaagagcagagctaa

SEQ ID NO: 2358 - DNA, 447 bp, Enterobacter sp.
ctcaataaattattgggaaatgagcttgtcgcaatcaatcagtattttctccatgcaagaatgttcaaaaactggggactgactcgcctcaatgatgttgaataccatgagtccatcgacgagatgaagcacgcggataaatatattgagcgtattttattcctcgaaggcattccaaacttgcaggatcttggcaaactgggcattggtgaagatgttgaggagatgctgcgttccgatctcagactggaactcgaaggcgcaagagatcttcgtgaagccatcgcctatgctgacagcgtccatgattatgttagtcgtgacatgatgatccagatcctcgccgatgaagaaggccatattgactggctggagactgaactggatctcattaccaaaattggcctacagaactaccttcagtcgcagatcaaagtggaaagctaa

SEQ ID NO: 2359 - DNA, 477 bp, Arsenophonus sp.
atgaaaggcgataaaagaatgatcacccatttaaatacattattgggtaatgagcttgttgcaatcaatcaatattttttacatgcccgtatgtttaaaaattggggtttattacgtcttaataatattgaatatgaagaatctattgatgagatgaaacatgctgataaatatatagaaaggatcctctttcttgaaggtataccaaatttgcaggatttaggtaaattaaatattggtgagaatgttgaagaaatgcttaaatcagatttattgcttgaattggaaggggcgagagatttgcgttcagcaattgcttatgcggattcagttagtgattatgttagtcgcgatttaatgattgaaatactaacggatgaagaaaaacatattgattggatagaaacgcaattggttttgatagcaaacataggcctaaaaaattacctacaatctcagctgggtgaagaggcatga

SEQ ID NO: 2360 - DNA, 438 bp, Pantoea sp.
aaactgcttggaaatgagctggttgccatcaatcagtactttttgcatgcacggatgttcaaaaactgggggctgacacgcctcaacgatgtcgaataccacgaatcgatcgatgagatgaagcatgccgacaagtacattgaacgcattctttttctggaaggcattcccaacctgcaggacttaggccggcttcgcattggtgaagatgttgaagagatgctgggttccgatcttgcgctggagctggaaggggcaaaagatctgcgtgaagcgatctcctatgcagacaaagttcatgactacgtcagtcgtgacatgatgatagaaatcctcgccgatgaggaacaccatatcgactggatcgaaaccgaacttgagcttatccggaaaatggggatccagaactatctgcaggcgcagatcaaagaagagtaa

SEQ ID NO: 2361 - DNA, 486 bp, Vibrio sp.
atgaaaggcgatccaatcataattcaacatctcaataaaattcttggtaacgagctcgttgccattaaccaatattttcttcatgcgcgaatgtacaaagactggggtctaaagcatttggctgataaggaatatcatgaatctattgatgagatgaaacatgccgaccacctgatagaacgaatcttgtttctcgaagggctacctaatctgcaagatctaggcaaactcaaaataggtgaagatacgcaagagatgctagagtgcgatctcgcgttggagatggaagccattcctgatctgaaaaatgccatcgcgtatgctgaagatattcatgattatgtatcacgcgatctgtttctcgaaatattggaagatgaagaagaacacgttgactggctagaaactcaactcggtcttgtgaagatgacgggtattcaaaattacctacaagcgcagtatgttgatgaagacgacgatggttaa

SEQ ID NO: 2362 - DNA, 462 bp, Sodalis sp.
atgaaaggtgatgcacagattatcaaccatctcaacaagctgcttggcaacgagcttgtagctatcaatcagtatttcctacatgcccggatgttcaagaattggggcctgatgcgtctcaacgatgttgaatatcacgaatccattgacgaaatgaaacacgcggattgctacatcgaacgcattctcttcctggaggggctgcctaatctgcaggatttcggccggctgaatatcggtgaggacgtggaagaaatgctgcgctccgatctctatttggaattgcagggcgcgcaagatctgcgtgaaggtatcgtctacgcggactcgatacgcgactatgtgtcgcgggacctgatgattgaaatcctaccgacgaagaagagcatattgattttctggaaaccgagctggcgcttattacccgtatcggcattcagaaccatctgcaatcacagttga

SEQ ID NO: 2363 - DNA, 483 bp, Vibrio sp.
atgaaaggcgatccaatcattattcaacatctcaataaaatccttggcaatgagttagttgccattaatcaatatttccttcatgcacgaatgtataaagactggggcttaaagcatctagccgataaggagtatcacgaatccatcgatgaaatgaatcatgcggatcatttgattgaacgtattctgtttcttgaaggcgtccctaacttgcaagatcttggtaagttaatgataggcgaagataccaaagagatgctggagtgcgaccttaagttagaaatggccgcgatacctgatctaaaagctgccattgcttacgcagaagacacacacgattatgtatccagagatctgtttcaggatatattggaagatgaagaagaacacgtagactggcttgaaacgcaacttggtttgatcgacatgacaggtattcaaaattacttgcaggctcaatatgttgatgaagatgatgactag

SEQ ID NO: 2364 - DNA, 1983 bp, Serratia sp.
atgactgagctgacgcccggcatcgccgcgcctctcggggcgcattatgacggtagcggcatcaactttaccctgttttccgcccacgccaccggcgtggaactgtgcctgttcgacgggcaacagcgcgaggtgcgtttgcctctgccggcgcgcagcggtgatatctggcacggctatctgccgggcggcaaaccgggccagcgctacgcttaccgggtgcacggcccgtttgatcccgcgcaggggctgcggtttaaccctaacaaactgctgctggatcccgccgcgcgcgcggtcgaggggccggtggcggacgatctggaactgcatggcggctacgaccggccggacccgcaggacagcgcagaggtgatgccgaagtgcgtggtcatcgacgaagcctacgattggcaggatgatcgcccgccggccacgccgtggggcaaaacggtgatttacgaagcgcacgtgcgcggcctcactctgctgcacccggatatcccgccggtgctgcgcggcagtttcgcagctctcgggcatccggtgatgatcgcccatttcaagcgcctcggcatcacggcgctggaactgttgccggttcagcagcatagctccgagccgcgtctacagcgtctcgggctgattaactactggggatataacgtgctggcgccctatgcgccggataaccgttattgcagcctgcgcaccgacatgacgccgctgcgtgaatttcgcgatgcggtgaaggcgctgcacaaggccggtatcgaggtgatcctcgacgtagtgttcaaccacagcgccgagctggacatggacgggccgacgctgtcgctgcgcggtatcgataacccggagtattactggctgactcccgacgggggatacgttaacgacaccggctgcggcaacacgctgcggttggataaaccgcagggcgtggcctgggtgatggactgtctgcgtttctgggtgagcgaatgtcatgtcgacggttttcgcttcgatttgggtagcgtactggggcgcaccccggcgttcgatcgcgatgcgccgctgttccaggcgatgctggcggacgatttgctgtcgcgctgcaagctgatcgccgagccgtgggacattggccccggcggttatcaggtgggcgcttttccggggcgcttcgccgagtggaatgaccattaccgggatgatatacgtcgcttttggctgcagggcgatttgccgcttggccagtttgcccaacgctttgccggttccagcgatttgttcaaccaacgcgggcgtgcgccgtacgccggcatcaacatgctgaccgctcatgacgggtttaccctgcaggatctggtcagttttaaccgcaaacacaaccagcttaacggtgaaggcaaccgtgacggcagcgaccataatttcagctataaccacggtgttgaaggcccgattgccgacgacgccattgtgcaacgccgcagggccagccggcaggcgctgcttgccacgttgttgctgtcccaggggacgccgatgctgctggccggcgatgagcatggacacagccagcaggggaacaacaatgcctattgtcaggacaacgccatcacctggctcgactgggccaaggcggatgactcgctcaccgcttataccgcagcgctgattcacctgcgccggcagatccccgctctgcagcaagaccgctggtggcaggagggcgacggcagcgtgcagtggctgaacgcccaagggctgccgcctgcggcgcaagaatgggagcagggagatttgcaattgcagatccgcttgtcgcagcgctggctggtggtggttaacgccacgccgcagccggtggagatgaggttgcctgcgggcgattggcaggttgtcgccccttttactcaggaaggaccgcaggcggttttacccgcctggaaccaggctgcgcactcgatttgcgtgctggtacagaaataa

SEQ ID NO: 2365 - DNA, 1983 bp, Serratia sp.
atgactgagctgacgcccggcatcgccgcgcctctcggggcgcattatgacggtaacggcatcaactttaccctgttttccgcccacgccaccggcgtggagctgtgcctgtttgacgggcaacagcgcgaggtgcgtctgccgctgccggcgcgcagcggtgatatctggcacggctatctgccgggcggcaaaccgggccagcgctacggttaccgggtgtacggcccgtttgatcccgcgcaggggctgcggtttaaccctaacaaactgctgctggatcccgccgcccgcgcggtcgaggggccggtggcggacgatctggaactgcatggcggctacgaccggccggacccgcaggacagtgcagaggtgatgccgaagtgcgtggtcatcgacgaagcctacgattggcaggatgaccgcccgccggccacgccgtggggcaaaacggtgatttatgaagcgcacgtgcgtggcctgactctgctgcacccggatatcccgccggtgctgcgcggcagtttcgccgctctcgggcatccggtgatgatcgcccatttcaagcgcctcggcatcacggcgctggaactgttgccggtacagcagcatagctccgagccgcgtctgcagcgtctcgggctgattaactactggggatataacgtgctggcgccctatgcgccggataaccgttattgcagcctgcgcaccgacatgacgccgttgcgtgaatttcgcgatgcggtgaaggcgctgcacaaggccgggattgaggtgatcctcgacgtggtgttcaaccacagcgccgagctggacatggacgggccgacgctgtcgcagcgcggcatcgataacccggggtattactggctgactcccgacgggggatacgttaacgacaccggctgtggcaacacgctgcggttggataaaccgcagggcgtggcctgggtgatggagtgcctgcgtttctgggtgagcgaatgtcatgtcgacggttttcgcttcgatctgggcagcgtgctgggccgtaccccggcgttcgatcgcgatgcgccgctgttccaggcgatgctggcggacgatctgctgtcgcgttgcaagctgatcgccgagccgtgggacattggccccggcggttatcaggtgggcgcttttccggggcgcttcgccgagtggaatgaccattaccgggatgatatacgccgcttttggctgcagggcgatataccgcttggccagtttgcccaacgctttgccggctccagcgatttgttcaaccaacgcgggcgtgcgccgtacgccggcatcaacatgctgaccgctcatgacgggtttaccctgcaggatctggtcagttttaaccgtaagcacaaccagcttaacggtgaaggcaaccgtgacggcagcgaccataatttcagctataaccacggtgttgaaggcccgattgccaacgacgccattgtgcaacgccgcagggccagccggcaggcactgcttgctacgttgttgctgtcccaggggacgccgatgctgctggccggcgatgagcatggacacagccagcagggtaacaacaatgcctattgtcaggacaacgccatcacctggctcgactgggccaaggcggatgactcgctcaccgcttataccgcagcgctgattcacctgcgccggcagatccccgccctgcagcaagaccgctggtggcaggagggcgacggcagtgtgcagtggctgaacgcgcaagggctgccgcttgcggcgcaagaatgggagcagggaaacttgcaactgcagatccgcctgtcgcagcgctggctggtggtggttaacgccacgccgcaggcggcggagatgaggttgcctgcgggtgattggcaggttgtcgccccctttactcaggaaggatcgcgggcggttttacccgcctggaaccaggctgcgcactcgatttgcgtgctggtacagaaataa

SEQ ID NO: 2366 - DNA, 1983 bp, Serratia sp.
atgactgagctgacgcccggcatcgccgcgcctctcggggcgcattatgacggtaacggcatcaactttaccctgttttccgcccacgccaccggcgtggagctgtgcctgtttgacgggcaacagcgcgaggtgcgtctgccgctgccggcgcgcagtggcgatatctggcacggctatctgccgggcggcaaaccgggccagcgctacggttaccgggtgcacggccagtttgatcccgcgcaggggctgcggtttaaccctaacaaactgctgttggatcccgccgcccgcgcggtcgaggggccagtggcggacgatctggaactgcatggcggctatgaccggccggacccgcaggacagcgcagaggtgatgccgaagtgcgtggtcatcgacgaagcctacgattggcaggatgaccgcccgccggccacgccgtggggtaaaacggtgatttacgaagcgcacgtgcgcggcctcactctgctgcacccggatatcccgccggtgctgcgcggcagtttcgcagcgctcgggcatccggtgatgatcgcccatttcaagcgcctcggcatcacggcgctggaactgctgccggtacagcagcatagctccgagccgcgtctgcagcgtctcgggctgattaactactggggatataacgtgctggcgccctatgcgccggataaccgttattgcagcctgcgcaccgacatgacgccgctgcgcgaatttcgcgatgcggtgaaggcgctgcacaaggccgggattgaggtgatcctcgacgtggtgttcaaccacagcgccgagttggacatggacgggccgacactgtcgctgcgcggtatcgataacccggagtattactggcttgctcccgacgggggatacgttaatgacaccggctgtggcaacacgctgcggttggataaaccgcagggcgtggcctgggtgatggagtgcctgcgtttctgggtgagcgaatgtcatgtcgacggttttcgcttcgatctgggcagcgtgctgggccgtaccccggcgttcgatcgcgatgcgccgctgttccaggcgatgctggcggacgatctgctgtcgcgctgcaagctgatcgccgagccgtgggacattggccccggcggttatcaggtgggcgcttttccggggcgcttcgccgagtggaatgaccattaccgggatgatatgcgccgcttttggctgcagggcgatttgccgcttggccagtttgcccaacgctttgccggctccagcgatgtgttcaaccaacgcgggcgtgcgccgtacgccagcatcaacatgctgaccgctcatgacgggtttaccctgcaggatctggtcagttttaaccgtaagcacaaccagcttaacggtgaaggcaaccgtgacggcagcgaccataatttcagctataaccacggtgttgaaggcccgattgccgacgacgccattgtgcaacgccgcagggccagccggcaggcactgcttgccacgttgttgctgtcccaggggacgccgatgctgctggccggcgatgagcatggacacagccagcaggggaacaacaatgcctattgtcaggacaacgccatcacctggctcgactgggccaaggcggatgactcgctcaccgcttataccgcagagctgattcacctgcgccggcagatccccgccctgcagcaagaccgctggtggcaggagggtgacggcagcgtgcagtggttgaacgcgcaagggcacccgcctgcggcgcaagaatgggagcagggagatttgcaattgcagatccgcctgtcgcagcgctggctggtggtggttaacgccacgccgcagacggtggagatgaggttgcctgcgggcgattggcaggttgtcgccccctttactcaggaaggaccgcaggcggttttacccgcctggaaccaggctgcgcactcgatttgcgtgctggtacagaaataa

SEQ ID NO: 2367 - DNA, 1986 bp, Serratia sp.
atgactgagctgacgcccggcatcgccgcgcctctcggggcgcactatgacggtaacggcatcaactttagcctatattccgcccatgctaccggggtggagctgtgcctgtttgacgaacaacagcgtgaagttcgcctgccgctggcgacgcgcagcggtgatatttggcacggttatctgccgggcggcaaaccgggccagcgttatggataccgggtgcatggcccgtttgatcctgcgcaggggctgcgttttaaccccaataagctgctgctggatcccgccgcccgcgcggtcgaggggccggtggccgatgacccctacctgcatggtggctatgaccggccggatcggcatgacagcgccgagctgatgccaaagtgcgtggtgatcgacgaagcctacgactggcaggatgattgcccgccggccacgccgtggggcaaaacggtgatctacgaagcgcatgtgcgcggtctgaccctgcaacacccggatatcccgcaggtgctgcgtggcagttttgccgcacttgggcatccggtgatgatcgcctacttcaagcgccttggcattaccgcgctggaactgctgccggtgcagcagcacagctccgagccgcgcctgcaacgcctcgggttgattaactactggggctataacgtgctggcgccctatgcgccggataaccgttactccagcctgcgtaccgacatgacgccgctgcgcgaattccgcgacgcggtgaaggcgctgcataaggccgggattgaagtgatcctcgacgtggtattcaaccacagcgccgagctggataccgacgggccgacgctgtcgctgcgtggcatcgataacccgggctattactggctcactcccgagggaggttacgtgaacgataccggctgcggtaacacgctgcggcttgatcaaccacagggcgtggcctgggtgatggactgcctgcgtttttgggtgggtgagtgtcacgtagacggcttccgctttgatctgggtagcgtgctcggccgcacgccagcgttcgatcgcgacgcgccgctgttccaggcgatgctggccgacgacctgctgtcgcgctgcaagttgattgccgaaccctgggatattggtcccggcggctatcaggtgggtgagtttcccgggcgctttgccgagtggaacgaccattaccgggacgatatgcgccgcttctggctgcagggcgatatttcgctcggtcagttcgcccagcgttttgccgcttccagtgacctgttcaaccaacgcgggcgtgcgccgtacgccagcatcaacatgctgaccgctcatgacggttttaccctgcaggatctggtcagctttagccgtaagcacaaccaactgaacggcgaaggtaaccgcgacggcagcgaccgtaactttagcaacaaccacggtgttgaaggcccgatagccgacgacgccattgtgcaacgccgtagggccagccggcaggtactgcttgccacgttattgctgtcccagggaacgccgatgctgctggccggcgatgaacatggacacagccagcagggtaacaacaatgcctattgtcaggacaacgctatcacctggctcgactgggccacggcggatgactcactcaccgcttacaccgccgcactgatccacctgcgccaacaaattcccgccctgcagcatgaccgctggtggcaggagggcgacggtaacgtgcagtggctgaacgcgcaggggcaatcgctcagcgcgcaacagtgggagcagggagatctgcagttgcagatctgtctgtcacaacgctggctggtggtagtgaacgccacgcagcaggcggtggagatgacgttgcctgccggcgattggcagcttgtcgccccctttactcaggaagattcgcgggcggtcttacccgcctggaaccaggctgcgcactcgatttgcgtgctggtcaagaaaaaataa

SEQ ID NO: 2368 - DNA, 1983 bp, Serratia sp.
atgactgagctgacgccgggtatcgccgcgcctctcggggcgcattatgacggtaatggcatcaactttagcctgtattcctcccatgctacgggagttgaactgtgtctgttcgatgaacagcaacgcgaaatacgtctgccgctgacgacgcgtagcggtgatatctggcacggctatctgccgggaggcaaaccgggccagcgttacggttaccgggtacatggcccgttcgatcctgcacaagggttgcgttttaatcccaataaactgctgttggatccagcagcccgtgcggtagagggacccgtggcggacgatccctatctgcatggtggctatgaccgcccagaccagcatgacagcgccgggttgatgccgaaatgcgtggtgatcgacgaggtttacgattggcaagatgaccgtcccccagccacgccgtggggtaaaacggtgatctacgaagcgcacgtgcgtggtttgaccctacaacacccagatatcccgcaggtgctgcgcagcagtttcgctgcgctcggtcatccggtgatgatcgcgtatttcaagcgccttggtattacggcgctggaactgctgccggtgcagcagcacagctctgagccacgcttgcagcgcctcgggttgattaattactggggttataacgtgttggcgccttttgcgccggataaccggtattccagcctgcgagccgacatgacaccgctgcgtgagtttcgcgatgcggttaaagcgctgcataaggccggtattgaagtgattctcgatgtggtgttcaaccatagcgccgagcttgatatggatgggccaacgctgtcgttacgcggcattgataacccgggctactactggctgacaccggatggcgactacgtgaacgatactggttgtggtaacaccctgcgattggatcagccgcagggtgtggcttgggtgatggactgcctgcgtttctgggtaggtgaatgccatgttgatggtttccgcttcgatttgggtagcgtactcggccgcacgccagcgtttgatcgcgatgcaccgctgttccaggcgatgctggcggacgatctgttgtcgcgctgcaaactgattgccgagccgtgggatatcggccccgggggttatcaggtcggcgagtttcccgggcgcttcgctgagtggaacgaccattatcgggatgacatgcgccgtttctggttacagggtgatgtctcgctgggtcagtttgcccaacgttttgccgcctccagtgatttgttcaaccgacgtgggcgtgcaccctacgccagtatcaatatgctgaccgcgcatgacggatttactttgcaggatctggtcagttttaaccgcaaacacaaccaactgaacggtgaaggtaaccgtgacggcagtgaccgtaattttagtaacaaccacggtgttgaaggccccattgccgacgacactattgtgcaacaccgcagggctagccagcgtgcactccttgccacgctgttactgtcccagggtacgccgatgctgctggccggcgacgaacatggacacagccagcagggcaacaacaatgcctattgtcaggacaacgctatcacctggctcgactgggccgcggcggatgactcactcaccacatacaccgctgcactgatccgtctgcgtcaacaaattcccgccttgcagcaagaccgctggtggcaggaaggcgacggtagcgtgcagtggctgaacgcgcaggggcagtcgctcggcgcacaacagtgggagcaggggacgctgcagttgcagatccgcttgtcgcaacgctggctggtggtggtgaacgccacgcaacaggccgttgagatgacgttgcccgaaggcgattggcagcttgttgccccttttactcaggaagattcgcgggcggttttacccgtctggaaccaggctgcgcactcgatttgcgtgctggtaaagaaataa

SEQ ID NO: 2369 - DNA, 1986 bp, Multievos46 sp.
atgactgagctgacgcccggcatcgccgcgcctctcggggcgcactatgacggtaacggcatcaactttagcctctattctgcccgagccacgggggtggagctttgcctgtttgacgaacagcagcaggaggttcggctgccactgacggtgcgcagcggtgatatctggcacggctacctgccgggcggtaaaccggggcagcgttacggtttccgcgtatatggtccgtttgatcctgcgcaggggttgcgttttaaccccaacaaactgctgttggatcccgccgcgcgcgcggtagagggaccggttgcagatgatccttacctgcatggcggctatgaccggccggatcagcatgacagcgccgaactgatgcccaagtgcgtggtgattgacgaagcttacgattggcaggatgaccgcccgccggccacgccctggggtaaaacggtgatctacgaagcgcatgtgcgcggcctgaccttgcagcatccggaaatcccaccggtgttgcgcggtagcttcgccgcgctcggtcacccggtgatgattgcctatttcaagcggctcggcatcactgcgctggagttgttgccggtgcagcagcacagttctgaaccgcgtctgcagcggctcggactgattaattactggggctataacgtacttgcgccctttgcgccggataaccggtattccagcctgcgcactgatacgacgccgctgcgcgagtttcgcgatgcggtgaaagcgctgcataaggccggtattgaggtgatccttgacgtggtgttcaaccacagcgccgagctggataccgatgggccgacgttgtcgctgcgcggtatcgataacccgggctattactggctcacccccgacggcgactatgtgaacgataccggctgcggtaacacgctgcgattggatcagccacagggcgtggcctgggtgatggactgtctgcgtttttgggtgggcgaatgccacgttgatggcttccgcttcgatctgggcagcgtacttggccgtacgcctgcgttcgaccgcgatgcgccgttgttccaggcgatactggcggacgacctgctttctcgctgcaagctgatcgccgagccgtgggatatcgggcctggcggttaccaggtgggccaattcccggggcgcttcgccgagtggaacgaccattaccgggacgatatccgtcgtttctggctgcaggacggcatatcgttggggcagttcgcccaacgtttcgccgcttccagtgatctgtttaaccaacgcgggcgtgcgccgtacgccagcatcaacatgctgaccgctcatgacgggttcaccctgcaggacttggtcagttttaaccgcaagcacaaccaactgaacggtgaaggtaaccgtgacggcagtgatcgtaactttagcaataaccacggtgttgaaggcccgattgccgacgatgccattttgcaacgccgcagggccagccgacgagcgctgctcgccacgttgttgctgtcccaggggacgccgatgctgctggccggcgacgagcatggacacagccagcagggcaacaacaatgcctattgtcaggacaacgctatcacctggctcgactgggccacggcagatgacgctctcaccgattacaccgcagcactgatccgtttacgccaacaaatccctgccttgcagcaagaccgctggtggcaggagggtgacggcagcgtgcagtggctgaacgcgcaggggcaacccctcgacgcacaagagtgggagcagggggaactgcggttgcagatctgtctgtcgcaacgctggctggtggtcgtgaacgccacgcagcaggcggtggagatgacgttgcccgtcggcgattggcagcttgtcgctccctttactcaggaagattcgcgggcggttttacccgcctggcaccaggctgcgcactcgatttgcgtgctggtaaagaaaaaataa

SEQ ID NO: 2370 - DNA, 1986 bp, Serratia sp.
atgactgagctgacgcccggcatcgccgcgcctctcggggcgcactatgacggtaacggcatcaactttagcctgtattccgcccgagccacgggggtggagctgtgcctgtttgacgagcagcagcaggaggttcggctgctactgacggcgcgcagcggtgatatctggcacggctacctgccgggcggtaaaccggggcagcgttacggtttccgcgtacatggtccgtttgatcctgcgcaggggttgcgttttaaccccaacaaactgctgttggatcccgccgcgcgcgcggtggagggaccggttgcagatgatccttacctgcatggcggctatgaccggccggatcagcatgacagcgccgaactgatgcccaagtgcgtggtgattgacgaagcttacgattggcaggatgaccgcccgccggccacgccctggggcaaaacggtgatctacgaagcgcatgtgcgcggcctgaccttgcagcatccggagatcccaccggtgttgcgcggtagcttcgccgcgctcggtcacccggtgatgattgcctatttcaagcggctcggcatcactgcgctggagttgttgccggtgcagcagcacagttctgaaccgcgtctgcagcggctcggattgattaattactggggctacaacgtacttgcgccctttgcgccggacaaccgttattccagcctgcgcactgatacgacgccgctgcgcgagtttcgcgatgcggtgaaagcgctgcataaggccggtattgaggtgatcctcgacgtggtgttcaaccacagcgccgagctggataccgacggcccgacgttgtcgctgcgcggtatcgataacccgggctattactggctcacccccgacggcgactacgtgaacgataccggctgcggtaacacgctgcgattggatcagccacagggcgtggcctgggtgatggactgtctgcgtttttgggtgggcgaatgccacgttgatggcttccgcttcgatctgggcagcgtacttggccgtacgcctgcgttcgaccgcgatgcgccgttgtttcaggcgatactggcggacgacctgctttctcgctgcaagctgatcgccgagccgtgggatatcgggcctggcggttaccaggtgggccaattcccggggcgcttcgccgagtggaacgaccattaccgggacgatatccgtcgtttctggctgcaggacggcatatcgttggggcagttcgcccaacgtttcgccgcttccagtgatctgtttaaccaacgcgggcgtgcgccgtacgccagcatcaacatgctgactgctcatgacgggttcaccctgcaggacttggtcagttttaaccgcaagcacaaccaactgaacggtgaaggtaaccgtgacggcagtgatcgtaactttagcaataaccacggtgttgaaggcccgattgccgacgatgccattttgcaacgccgcagggccagccgacgagcgctgctcgccacgttgttgctgtcccaggggacgccgatgctgctggccggcgacgagcatggacacagccagcagggcaacaacaatgcctattgtcaggacaacgctatcacctggctcgactgggccacggcagatgacgctctcaccgattacaccgcagcactgatccgtttacgccaacaaatccctgccttgcagcaagaccgctggtggcaggagggtgacggcagcgtgcagtggctgaacgcgcaggggcaacccctcgacgcgcaagagtgggagcagggtgaactgcgtttgcagatctgtctgtcgcaacgctggctggtggtcgtgaacgccacacagcaggcggtggagatgacgttgcccgtcggcgattggcagcttgtcgctccctttactcaggaagattcgcgggcggttttacccgcctggcaccaggctgcgcactcgatttgcgtgctggtaaagaaaaaataa

SEQ ID NO: 2371 - DNA, 1986 bp, unknown
  environmental sample
atgactgagctgacgcccggcatcgccgcgcctctcggggcgcgctatgacggtaacggcatcaactttagcctctattccgcccgagccacgggggtggagctgtgcctgtttgacgagcagcagcaggaggttcggctgccactgacggcgcgcagcggtgatatctggcacggctacctgccgggcggtaaaccggggcagcgttacggtttccgggtgcatggtccgtttgatcctgcgcaggggttgcgttttaaccccaacaaactgctgttggatcccgccgcgcgcgcggtagagggaccggttgcagatgatccctatctgcatggcggctatgaccggccggatcagcatgacagcgccgaactgatgcccaagtgcgtggtgattgacgaagcttacgattggcaggatgaccgcccgccggccacgccctggggcaaaacggtgatctacgaagcgcatgtgcgcggcctgaccttgcagcatccggagatcccaccggtgttgcgcggtagcttcgccgcgctcggtcacccggtgatgattgcctatttcaagcggctcggcatcactgcgctggagttgttgccggtgcagcagcacagttctgaaccgcgtctgcagcggctcggactgattaattactggggctataacgtacttgcgccctttgcgccggataaccgttattccagcctgcgcactgatacgacgccgctgcgcgagtttcgcgatgcggtgaaagcgctgcataaggccggtattgaggtgatcctcgacgtggtgttcaaccacagcgccgagctggataccgatgggccgacgttgtcgctgcgcggtatcgataacccgggctattactggctcacccccgacggcgactacgtgaacgataccggctgcggtaacacgctgcgattggatcagccacagggcgtggcctgggtgatagactgtctgcgtttttgggtgggcgaatgccacgttgatggcttccgcttcgatctgggcagcgtacttggccgtacgcctgcgttcgaccgcgatgcgccgttgttccaggcgttgctggcggacgacctgctttctcgctgcaagctgatcgccgagccgtgggatatcgggcctggcggttaccaggtgggccaattcccggggcgcttcgccgagtggaacgaccattaccgggacgatatccgtcgtttctggctgcaggacggcatatcgttggggcagttcgcccaacgtttcgccgcttccagtgatctgtttaaccaacgcgggcgtgcgccgtacgccagcatcaacatgctgaccgctcatgacgggttcaccctgcaggacttggtcagttttaaccgcaagcacaaccaactgaacggtgaaggtaaccgtgacggcagtgatcgtaactttagcaataaccacggtgttgaaggcccgattgccgacgatgccattttgcaacgccgcagggccagccgacgagcgctgctcgccacgttgttgctgtcccaggggacgccgatgctgctggccggcgacgagcatggacacagccagcagggcaacaacaatgcctattgtcaggacaacgctatcacctggctcgactgggccacggcagatgacgctctcaccgattacaccgcagcactgatccgtttacgccaacaaatccctgccttgcagcaagaccgctggtggcaggagggtgacggcagcgtgcagtggctgaacgcgcaggggcaacccctcgacgcgcaagagtgggagcagggtgaactgcgtttgcagatctgtctgtcgcaacgctggctggtggtcgtgaacgccacgcagcaggcggtggagatgacgttgcccgtcggcgattggcagcttgtcgctccctttactcaggaagattcgcgggcggttttacccgcctggcaccaggctgcgcactcgatttgcgtgctggtaaagaaaaaataa

SEQ ID NO: 2372 - DNA, 1983 bp, Serratia sp.
atgacggagctgactgccggcctcgccgcgccgctgggcgcccattacgacggcgaaggcatcaactttaccctgtactcggcgcacgccgagcgggtggagctgtgcctgttcgacggccagcagcgcgaggtgcgcctgccgctgccggcgcgcagcggcgatatctggcatggctatttgccgggcggcaggccggggcaacgttacggttaccgggtctacggcccgttcgacccggcgaacggaccgcgtttcaaccccaacaagctggcgctcgatccggccgcgcgcgcggtggaggggccggtggcggaccacccgcacctgcacggcggttacgaacagcctgatccgcacgacagcgccgagctgatgccgaagtgcgtggtggtggacgaacagtatgactggcaggacgatcgcccgcctgccacgccctgggggcagactgtgatttacgaagcgcacgtgcgcggcctgacgctgctgcacccgaagatcccgccggcgctgcgcggcagctttgccgcgctggggcacccggtgatgatcgcccacttcaaacgcctcggcatcaccgcgctggaactgctgccggtgcagcaacatacctccgaaccgcggctgcagcggctggggctgatcaactattggggctataacgtgctggcgccctatgcgccggacaaccgctacgccagcctgagcaccgacggcacgccgctgaacgaattccgcgatgcggtcaaggcgctgcaccaagccggcatcgaggtgatcctcgacgtggtgttcaaccacagcgccgagctggatatggacgggccgatgctgtcgctgagcggcatcgataacctgagctactactggctgacgcccgaaggggactatgtcaacgacaccggctgcggcaataccctgcggctcgatcagccgcagggcgtggcctgggtgatggattgcctgcgtttttgggtgcgggaatgccacgtcgacggcttccgcttcgatctgggcagcgtgctcggccgcacgccggggttcgatcgcgatgcgccgctgttccagacgatgctggcggacgatctgctgtcgcgctgcaagctgatcgccgaaccctgggacgttggtcccggcggctatcaggtgggggcgttccccggccgcttcgccgaatggaacgaccattatcgcgacgacatgcgccgtttctggctgcagagcggcgtgtcgctcgggcagttcgcccggcgtttcgccgcctccagcgatctgtacaaccagcgtgggcgggcgccttacgccaccgtcaacatgctgaccgcccatgacggttttactctgcaggacgtggtcagcttcaacgagaaacacaaccagccgaacggcgaaggcaaccgcgacggcagcgatcgcaatttcagcaacaaccacggcgtggaaggcctggtcgccgacgacgccattgtgcaacgccgcagggccagccagcgggcgatgctcgccacgctgttgctgtcccagggaacgccgatgctgctggccggcgatgaacagggacatagccagcaggggaacaacaacgcctattgtcaggacaacgccatcacctggctcgattgggccacggcggatgacgcgttgaccgattacgtcgcggcgctgatcgcgctgcgccgccagatccccgcgttgcaacaggaccgctggtggcagcaggacgacggcagcgtgcagtggctgaacgcgcaagggcagccgctcgacgcgcagcagtgggagcaaggcgatctgctcatgcagatcctgctgtcgcagcgctggctgctgctggtcaacgccacgccgcaaacggtggagatgaggttgccggaaggcgattggcaggttgtcgccccgttcactcaggaagactcacgggcggtgttacccgcctggcaccaggacgcgcgctcgctttgcgttctggtacggaaataa

SEQ ID NO: 2373 - DNA, 1983 bp, Serratia sp.
atgacggagctgacggccggcctcgccgcgccgctgggcgcgcattacgacggcgaaggcatcaactttaccctgtactcggcgcacgccgagcgggtggagctgtgcctgttcgacggccagcaacgcgaagtgcgcctgccgctgccggcgcgcagcggcgatatctggcatggctatttgccgggcggcaggccggggcaacgttacggttaccgggtctacggcccgttcgacccggcgaacgggcagcgtttcaaccccaacaagctggcgctcgatccggccgcgcgcgcggtggaggggccggtggcggatcacccgcacctgcacggcggttacgaacagcctgatccgcacgacagcgccgagctgatgccgaaatgcgtggtggtggacgaacagtacgactggcaggacgatcgcccgcccgccacgccctgggggcagacggtgatttacgaagcgcacgtgcgcggcctgacgctgctgcacccgaagatcccgccggcgctgcgcggcagtttcgccgcgctggggcacccggtgatgatcgcccacttcaaacgcctcggcatcaccgcgctggaactgctgccggtgcagcaacatacctccgaaccgcggctgcagcggctggggctgatcaactactggggctataacgtgctggcgccctatgcgccggacaaccgctacgccagcctgagcaccgacggcacgccgctgaacgaatttcgcgatgcggtcaaggcgctgcaccaagccggcattgaggtgatcctcgacgtggtgttcaaccacagcgccgagctggacagggacgggccgatgctgtcgctgagcggcatcgataaccagagctactactggctgacgccggaaggggactacgttaacgacaccggctgcggcaataccctgcggctcgatcagccgcagggcgtggcctgggtgatggattgcctgcgtttttgggtgcgggagtgccacgtcgacggcttccgcttcgatctgggcagcgtgctcggccgcacgccggggttcgatcgcgatgcgccgctgttccaggcgatgctggcggacgatgtgctgtcgcgctgcaagctgattgccgaaccctgggacgttggccccggcggctatcaggtaggggcgttccccggccgcttcgccgaatggaacgaccattaccgcgacgacatgcgccgtttctggctgcagagcggcgtgtcgctcggccagttcgcccggcgtttcgccgcctccagcgatctgtacaaccagcgcgggcgggcgccttacgccaccgtcaacatgctgaccgcccatgacggttttaccctgcaggacgtggtcagcttcaacgagaaacacaaccagccgaacggcgaaggcaaccgtgacggcagcgatcgcaatttcagcaacaaccacggcgtggaaggcctggtcgccgacgacgccattgtgcaacgccgcagggccagccagcgggcgatgctcgccacgctgttgctgtcccagggaacgccgatgctgctggccggcgatgaacagggacacagccagcaggggaacaacaacgcctattgtcaggacaacgccaccacctggctcgattgggccacggcggatgacgcgctgaccgattacgtcgcggcgctgatcgcgctgcgccgccagatccccgcgttgcaacaggaccgctggtggcagcaggacgacggcagcgtgcagtggctgaatgcgcaagggcagcctctcgacgcgcagcagtgggagcaaggcgatctgctcatgcagatcctgctgtcgcagcgctggctgctgctggtcaacgccacgccgcaaacggtggagatgaggttgccggaaggcgattggcaggttgtcgccccgttcactcaggaagactcacgggcggtgttacccgcctggcaccaggccgcgcgctcgctttgcgttctggtacggaaataa

SEQ ID NO: 2374 - DNA, 1983 bp, Serratia sp.
atgacggagctgacggccggcctcgccgcgccgctgggcgcgcattacgacggcgaaggcatcaactttaccctgtactcggcgcacgccgagcgggtggagctgtgcctgttcgacggccagcaacgcgaagtgcgcctgccgctgccggcgcgcagcggcgatatctggcatggctatttgccgggcggcaggccggggcaacgttacggttaccgggtctacggcccgttcgacccggcgaacgggcagcgtttcaaccccaacaagctggcgctcgatccggccgcgcgcgcggtggaggggccggtggcggatcacccgcacctgcacggcggttacgaacagcctgatccgcacgacagcgccgagctgatgccgaaatgcgtggtggtggacgaacagtacgactggcaggacgatcgcccgcccgccacgccctgggggcagacggtgatttacgaagcgcacgtgcgcggcctgacgctgctgcacccgaagatcccgccggcgctgcgcggcagtttcgccgcgctggggcacccggtgatgatcgcccacttcaaacgcctcggcatcaccgcgctggaactgctgccggtgcagcaacatacctccgaaccgcggctgcagcggctggggctgatcaactactggggctataacgtgctggcgccctatgcgccggacaaccgctacgccagcctgagcaccgacggcacgccgctgaacgaatttcgcgatgcggtcaaggcgctgcaccaagccggcatcgaggtgatcctcgacgtggtgttcaaccacagcgccgagctggatagggacgggccgatgctgtcgctgagcggcatcgataaccagagctactactggctgacgccggaaggtgactacgtcaacgacaccggctgcggcaacaccctgcggctcgatcagccgcagggcgtggcctgggtgatggattgcctgcgtttttgggtacgggagtgccacgtcgacggtttccgcttcgatctgggcagcgtgctcggccgcacgccgggattcgatcgcgatgcgccgctgttccaggcgatgctggcggacgatgtgctgtcgcgctgcaagctgatcgccgaaccctgggacgttggccccggcggctatcaggtgggggcgttccccggccgcttcgccgaatggaacgaccattatcgcgacgacatgcgccgtttctggctgcagagcggcgtgtcgctcggccagttcgcccggcgtttcgccgcctccagcgatctgtacaaccagcgcgggcgggcgccttacgccaccgtcaacatgctgaccgcccatgacggttttaccctgcaggacgtggtcagcttcaacgagaaacacaaccagccgaacggcgaaggcaaccgtgacggcagcgatcgcaatttcagcaacaaccacggcgtggaaggcctggtcgccgacgacgccattgtgcaacgccgcagggccagccagcgggcgatgctcgccacgctgttgctgtcccagggaacgccgatgctgctagccggcgatgaacagggacacagccagcaggggaacaacaacgcctattgtcaggacaacgccaccacctggctcgattgggccacggcggatgacgcgttgaccgattacgtcgcggcgctgatcgcgctgcgccgccagatccccgcgttgcaacaggaccgctggtggcagcaggacgacggcaacgtgcagtggctgaatgcgcaagggcagccgctcgacgcgcagcagtgggagcaaggcgatctgctcatgcagatcctgctgtcgcagcgctggctgctgctggtcaacgccacgccgcaaacggtggagatgaggttgccggaaggcgattggcaggttgtcgccccgttcactcaggaagactcacgggcggtgttacccgcctggcaccaggccgcgcgctcgctttgcgttctggtacggaaataa

SEQ ID NO: 2375 - DNA, 1983 bp, Serratia sp.
atgacggagctgacagccggcctcgccgcgccgctgggcgcgcagtacgacggcgaaggcatcaactttaccctgtactcggcgcacgccgagcgggtggagttgtgcctgttcgacggccagcagcgcgaagtgcgcctgccgctgccggcgcgcagcggcgatatctggcatggctatttgccgggcggcaagccgggacaacgttacggttaccgggtctacggcccgtttgatccggcgaacgggcagcgcttcaaccccaacaaactggcgctcgatccggccgcgcgcgcggtggaagggccggtggcggaccacccgcacctgcacggcggttacgagcagccggacccgcacgacagcgcggagctgatgccgaaatgcgtggtggtggacgaacggtacgactggcaggacgatcgcccgcccgccacgccctgggggcagacggtgatttacgaagcgcacgtgcgcggtctgacgctgctgcacccgcagataccgccggcgctgcgcggcagcttcgccgcattggggcacccggcgatgatcgcccacttcaaacgcctcggcatcaccgcgctggaactgctgccggtgcagcaacatacctccgaaccgcgcctgcagcggctggggctgatcaactattggggctataacgtgctggcgccctatgcgccggacaaccgctacgccagcctgagcaccgatgccacgccgctcaacgaattccgcgatgcggtcaaggcgctgcaccaagccggcatcgaagtgatcctcgatgtggtgtttaaccacagcgccgagctggacagggacgggccgatgctgtcgctgagcggcatcgataacctgagctactactggctgacgcccgaaggggactatgtcaacgataccggctgcggcaacacgctgcggttggatcagccgcagggcgtggcctgggtgatggattgcctgcgtttttgggtgcgggagtgccacgtcgacggcttccgtttcgatctgggcagcgtgctcggccgcacgccggggttcgatcgcgatgcgccgctgttccaggcgatgctggcggacgatctgctgtcgcgctgcaagctgatcgccgaaccctgggacattggccccggcggttatcaggtgggggcgttccccggccgcttcgccgaatggaacgaccattaccgcgacgacatgcgccgtttctggctgcagagcggcgtgtcgctcggccagttcgcccggcgttttgccgcctcgagcgatctgtacaaccagcgcgggcgggcgccttacgccaccgtcaacatgctgaccgcccatgacgggtttaccctgcaggacgtggtcagcttcaacgagaaacacaatcagccgaacggcgagggcaaccgcgacggcagcgatcgcaatttcagcaacaaccacggcgtcgaaggcctggtcgccgacgacgccattgtgcaacgccgcagggccagccagcgggcgatgctcgccacgctgttgctgtcccagggtacgccgatgctgctggccggcgatgaacagggacacagccagcaggggaacaacaatgcctattgtcaggacaacgccaccacctggctcgactgggccacggcggacgacgcgctgaccgattacgtcgcggcgctgatcgcgctgcgccgccagatccccgcgctgcagcaggaccgctggtggcagcaggacgacggcagcgtgcagtggctgaacgcgcaaggccagccgctcgacgcgcagcagtgggagcggggcgagttgctcatgcagatcctgctgtcgcagcgctggctgctgctggtcaacgccacgccgcaaacgacggagatgagattgccggaaggcgattggcaggttgtcgctccgttcactcaggaagactcacgggcggtattgcccgcctggcaccaggccgcgcgctcgctttgcgtactggtacggaaataa

SEQ ID NO: 2376 - DNA, 1983 bp, Serratia sp.
atgacggagctgacagccggcctcgccgcgccgctgggcgcgcagtacgacggcgaaggcatcaactttaccctgtactcggcgcacgccgagcgggtggagttgtgcctgttcgacggccagcagcgcgaagtgcgcctgccgctgccggcgcgcagcggcgatatctggcatggctatttgccgggcggcaagccgggacaacgttacggttaccgggtctatggcccgtttgatccggcgaacgggcagcgcttcaaccccaacaaactggcgctcgatccggccgcgcgcgcggtggaagggccggtggcggaccacccgcacctgcacggcggttacgagcagccggacccgcacgacagcgcggagctgatgccgaaatgcgtggtggtggacgaacggtacgactggcaggacgatcgcccgcccgccacgccctgggggcagacggtgatttacgaagcccacgtgcgcggcctgacgctgctgcacccgcagataccgccggcgctgcgcggcagcttcgccgcattggggcacccggcgatgatcgcccacttcaaacgcctcggcatcaccgcgctggaactgctgccggtgcagcaacatacctccgaaccgcgcctgcagcggctggggctgatcaactattggggctataacgtgctggcgccttatgcgccggacaaccgctacgccagcctgagcaccgatgccacgccgctcaacgaattccgcgatgcggtcaaggcgctgcaccaagccggcatcgaagtgatcctcgatgtggtgtttaaccacagcgccgagctggacagggacgggccgatgctgtcgctgagcggcatcgataacctgagctactactggctgacgcccgaaggggactatgtcaacgataccggctgcggcaacacgctgcggttggatcagccgcagggcgtggcctgggtgatggattgcctgcgtttttgggtgcgggagtgccacgtcgacggcttccgtttcgatctgggcagcgtgctcggccgcacgccggggttcgatcgcgatgcgccgctgttccaggcgatgctggcggacgatctgctgtcgcgctgcaagctgatcgccgaaccctgggacattggccccggcggttatcaggtgggggcgttccccggccgcttcgccgaatggaacgaccattaccgcgacgacatgcgccgtttctggctgcagagcggcgtgtcgctcggccagttcgcccggcgttttgccgcctcgagcgatctgtacaaccagcgcgggcgggcgccttacgccaccgtcaacatgctgaccgcccatgacgggtttaccctacaggacgtggtcagcttcaacgagaaacacaatcagccgaacggcgagggcaaccgcgacggcagcgatcgcaatttcagcaacaaccacggcgtcgaaggcctggtcgccgacgacgccattgtgcaacgccgcagggccagccagcgggcgatgctcgccacgctgttgctgtcccagggcacgccgatgctgctggccggcgatgaacagggacacagccagcaggggaacaacaatgcctattgtcaggacaacgccaccacctggctcgactgggccacggcggacgatgcgctgaccgattacgtcgcggcgctgatcgcgctgcgccgccagatccccgcgctgcagcaggaccgctggtggcagcaggacgacggcagcgtgcagtggctgaacgcgcaaggccagccgctcgacgcgcagcagtgggagcggggcgagcggctcatgcagatcctgctgtcgcagcgctggctgctgctggtcaacgccacgccgcaaacgacggagatgagattgccggaaggcgattggcaggttgtcgccccgttcactcaggaagactcacgggcggtattgcccgcctggcaccaggccgcgcgctcgctttgcgtactggtacggaaataa

SEQ ID NO: 2377 - DNA, 1983 bp, Serratia sp.
atgacggagctgacggccggccgcgccgcgccgctgggcgcgcattacgacggcgaaggcatcaactttaccctgtactcggcgcatgccgagcgggtggagctgtgcctgttcgacggccagcagcgtgaggtgcgcctgccgctgccggcgcgcagcggcgatatctggcatggctatttgccgggcggcaagccgggacaacgttacggttaccgggtctacggcccgttcgacccggcgaacggacagcggttcaaccccaacaagctggcgctcgatccggccgcgcgcgcggtggaagggccggtggcggaccacccgcacctgcacggcggttacgatcggccggatccgcacgacagcgccgagctgatgccgaaatgcgtggtggtggaccaatgctacgactggcaggacgatcgcccgcccgccacgccctgggggcagacggtgatttacgaagcgcacgtacgtggccttacgctgctgcacccgaagctcccgccggcgctgcgcggcagcttcgccgcgctggggcacccggtgatgatcgcccacttcaaacgcctcggcatcaccgcgctggaactgctgccggtgcagcaacatacctccgaaccgcgtctgcagcggctgggactgatcaactactggggctataacgtgctggcgccctatgcgccggacaaccgctacgccagcctgagcaccgacggcacgccgctgaacgaatttcgcgatgcggtcaaggcgctgcaccaagccggcatcgaggtgatcctcgacgtggtgttcaaccacagcgccgagctggatatggacgggccgatgctgtcgctgagcggcatcgacaaccagagctactactggctgacgccggaaggggactacgtcaacgacaccggctgcggcaataccctgcggctcgatcagccgcagggcgtggcctgggtgatggactgcctgcatttttgggtgcgggagtgccatgtcgacggcttccgcttcgatctgggcagcgtgctcggccgcacgccgggattcgatcgcgatgcgccgctgttccaggcgatgctggcggacgatgtgctgtcgcgctgcaagctgattgccgaaccctgggacgttggccccggcggctatcaggtgggggcgtttcccggccgcttcgccgaatggaacgaccattaccgcgacgacatgcgtcgtttctggctgcagagcggcgtgtcgctcggccagttcgcccggcgttttgccgcctccagcgatgtgtacaaccagcgcgggcgagcgccttacgccaccgtcaacatgctgaccgcccatgacggttttaccctgcaggatgtggtcagcttcaacgagaaacacaatcagccgaacggcgaaggcaaccgcgacggcagcgatcgcaatttcagcaacaaccacggcgtggaaggcctggtcgccgacgacgccattgtgcaacgccgcagggccagccagcgggcgatgcttgccacgctgttgctgtcccagggaacgccgatgctgctggccggcgatgaacagggacacagccagcaggggaacaacaacgcctattgccaggacaacgccaccacctggctcgactggtccacggcggatgacgcgctgaccgattacgtcgcggcgctgatcgcgctgcgccgtcggatccccgcgttgcaacaggaccgctggtggcagcaggacgacggcagcgtgcagtggctgaacgcacaagggcaggtgctcgacgcgcagcagtgggagcaaggcgatctgttcatgcagatcctgctgtcgcagcgctggctgctgctggtcaacgccacgccgcaaacggtggagatgaggttgccggaaggcgattggcaggttgtcgctccgttcactcaggaagactcacgggcggtgttacccgcctggcaccaggacgcgcgctcgctttgcgttctggtacggaaataa

SEQ ID NO: 2378 - DNA, 1983 bp, unknown
  environmental sample
atgaccgagctgacggccggcctcgccgcgccgctgggcgcgcagtatgacggcgaaggcatcaactttaccctgtactcggcgcacgccgaacgggtggagctgtgcctgttcgacggccagcagcgcgaagtgcgcctgccgctgccggcgcgcagcggcgatatctggcatggctacttgccgggcggcaggccggggcaacgttacggttaccgggtctacggcccgtttgacccggcgaacgggcagcgcttcaaccccaacaagctggcgctcgatccggccgcgcgcgcggtggaagggccggtggcggaccacccgcacctgcacggcggttacgagcagccggacccgcacgacagcgccgagctgatgccgaagtgcgtggtggtggacgaacagtatgactggcaggacgatcgcccgcccgccacgccctgggggcagacggtgatttacgaagcgcacgtgcgcggcctgacgctgctgcacccgcagatccctccggcgctgcgcggcagtttcgccgcgctggggcacccggcgatgattgcccacttcaaacgcctcggcatcaccgcgctagaactgctgccggtgcagcaacatacctccgaaccgcgcctgcagcggctggggctgatcaactactggggctataacgtgctggcgccctatgcgccggacaaccgctacgccagcctgagcaccgatgccacgccgctgaacgaattccgcgatgcggttaaggcgctgcaccaagccggcattgaggtgatcctcgacgtggtgttcaaccacagcgccgagctggacagggatgggccgatgctgtcgctgagcggcatcgataatctgagttactactggctgacgcccgaaggggactatgtcaacgacaccggctgcggcaacacgctgcggctcgatcagccgcagggcgtagcctgggtgatggattgcctgcatttttgggtgcgggagtgccacgtcgacggcttccgcttcgatctgggcagcgtgctgggccgcacgccggggttcgatcgcgatgcgccgctgttccaggcgatgctggcggacgatctgctgtcgcgctgcaagctgatcgccgaaccctgggacgttggccccggcggctatcaggtgggggcatttcccggccgcttcgccgaatggaacgatcattaccgcgacgacatgcgccgtttctggctgcagagcggcgtgtcgctcggccagttcgcccggcgttttgccgcttccagcgatctgtacaaccagcgcgggcgggcgccttacgccaccgtcaacatgctgaccgcgcatgacggctttaccctgcaagacgtggtcagcttcaacgagaaacacaatcagccgaacggtgagggcaaccgcgacggcagcgatcgcaatttcagcaacaaccacggcgtggaaggcctggtcgccgacgacgccattgtgcaacgccgcagggccagccagcgggcgatgctcgccacgctgttgctgtcccagggtacgccgatgctgctggccggcgatgaacagggacacagccagcaggggaacaacaatgcctattgtcaggacaacgccaccacctggctcgattgggccacggcggatgacgcgctgaccgattacgtcgcggcgctgatcgcgctgcgccgccagatccccgcgctgcagcaggaccgctggtggcagcaggacgacggcagcgtgcagtggctgaacgcgcaaggccagccgctcgacgcgcagcagtgggagcggggcgagctgctcatgcagatcctgctgtcgcagcgctggctgttgctggtcaacgccacgccgcaaacgacggagatgagattgccggaaggcgattggcaggttgtcgccccgttcactcaggaagactcacgggcggtattgcccgcctggcaccaggccgcgcgctcgctttgcgttctggtacggaaataa

SEQ ID NO: 2379 - DNA, 1983 bp, Serratia sp.
atgacggagctgacggccggcctcgccgcgccgctgggcgcgcattacgacggcgaaggcatcaactttaccctgtactcggcgcacgccgagcgggtggagctgtgcctgttcgacggccagcagcgcgaagtgcgcctgccgttgccggcgcgcagcggcgatatctggcatggctacttaccgggcggcaggccggggcaacgttacggttaccgggtctacggcccgtttgacccggcgaacggacagcgttttaaccccaacaaactggcgctcgatccggccgcgcgcgcggtggaagggccggtggcggatcacccgcacctgcacggcggttacgagcagccggacccgcacgacagcgcggagctgatgccgaagtgcgtggtggtggacgaacagtatgactggcaggacgatcgcccgcctgccacgccctggggacagacggtgatttacgaagcgcacgtgcgcggcctgacgctgctgcacccgcagatcccgccggcgctgcgcggcagcttcgccgcattggggcacccggcgatgatcgcccacttcaaacgcctcggcatcaccgcgctggaactgctgccggtgcagcaacatacctccgaaccgcgcctgcagcggctggggctgatcaactattggggctataacgtgctggcgccctatgcgccggacaaccgctacgccagcctgagcaccggtgccacgccgctgaacgaattccgcgatgcggtcaaggcgctgcacaaagccggcatcgaggtgatcctcgacgtggtgttcaaccacagcgccgagctggatatggacgggccgatgctgtcgctgagcggcatcgataacctgagctactactggctgacgcccgaaggggactatgtcaacgacaccggctgcggcaacacgctgcggttggatcagccgcagggcgtggcctgggtgatggattgcctgcgtttttgggtgcgggagtgccacgtcgacggcttccgtttcgatctgggcagcgtgctcggccgcacgccggggttcgatcgcgatgctccgctgttccaggcgatgctggcggacgatgtgctgtcgcgctgcaagctgatcgccgaaccctgggacattggccctggcggctatcaggtaggggcgtttcccggccgcttcgccgaatggaacgatcattaccgcgatgacatgcgtcgtttctggctgcagagcggcgtatcgctcggccagttcgcccggcgttttgccgcttccagcgatctgtataaccagcgcgggcgagcgccttacgccaccgtcaatatgctgaccgcccatgacggttttaccctgcaggacgtggtcagcttcaatgagaaacacaatcagcccaacggcgagggcaaccgcgacggcagcgatcgcaatttcagcaacaaccacggcgtcgaaggcctggtcgccgactacgccattgtgcaacgccgcagggccagccagcgggcgatgctcgccacgctgttgctgtcccagggaacgccgatgctgctggccggcgatgaacaggaacacagccagcaggggaacaacaatgcctattgtcaggacaacgccaccacctggctcgattgggccacggcggacgacgcgctgaccgattacgtcgcggcgctgatcgcgctgcgccgccagatccccgcgctgcagcaggaccgctggtggcagcaggacgacggcagcgtgcagtggctgaacgcgcaagggcaggcgctcgacgcgcagcagtgggagcagggcgagccgctcatgcagatcctgctgtcgcagcgctggctgctgctgatcaacgccacgccgcaaacgacggagatgaggttgccggaaggcgattggcaggttgtcgccccgttcactcaggaagactcacgggcggtattgcccgcctggcaccaggccgcgcgctcgctttgcgtactggtacggaaataa

SEQ ID NO: 2380 - DNA, 1983 bp, Serratia sp.
atgacggagctgacaaccggccttgccgcgccgctgggcgcgcattatgacggcgaaggtatcaacttcaccctgtattcggcgcacgccgagcgggtggagttgtgcctgttcgacggccagcagcgcgaagtgcgtttgccgctgccggcgcgcagcggcgacgtttggcacggctatctgccgggtggcaagccggggcagcgttacggctaccgggtctacggcccgttcgaaccggcgagcgggctgcgtttcaaccccaacaagctgtcgctcgatcccgccgcccgcgcggtggatgggccagtggcggatcacccgcacctgcacggcggttacgatcagccggatccgcacgacagtgcggaactgatgccgaaatgcgtggtggtggacgaacattacgactggcaggacgattgcccgcctgacacgccttggggacaaacggtcatctacgaagcgcacgtgcgcggcctgacgctgctgcacccggcgatcccgccggcgctgcgcggcagcttcgccgcgctggggcacccggtgatgatcgcctacttcaaacgccttggcatcaccgcgctggaactgctgcccgtgcagcaacatacctcagaaccgcgtctgcagcggctggggctgatcaactactggggctataacgtgctggcgccctatgcgccggacaaccgctacgccagtctgcgcaccgagggcacgccgctgaacgaattccgcgacgcggtcaaggcgctgcacaaagccggcatcgaggtgatcatcgacgtggtgttcaaccacagtgccgagctggatatggacgggccgatgctgtcgctgagcggcattgataacccgagctactactggctgacgccggaaggggattacgtcaacgacaccggctgcggcaacaccctgcggttggatcagccgcagggcgtggcctgggtgatggactgcctgcatttttgggtacgggagtgccatgtcgacgggtttcgcttcgatctgggcagcgtgctcggccgcacgccgggcttcgatcgcgatgcgccgctgtttcaggcgatgctggcggacgatctgctgtcgcgctgcaagctgatcgccgagccctgggacatcggccccggtggctatcaggtgggggcgtttcccgggcgcttcgccgaatggaacgaccattaccgcgacgacatgcgccgtttctggctgcagagcggcgtgtcgctcggccagttcgcccggcgcttcgccgcctccagcgatctgtataaccagcacgggcgggcgccctacgccaccgtcaacatgctgaccgcccatgacggctttaccctgcaagacgtggtcagcttcaacgagaaacacaaccagttgaacggcgaaggcaaccgtgacggcagcgatcgcaatttcagcaacaaccacggcgttgaaggcctggtcgccgacgacgccattgtgcaacgccgcagggccagccagcgggcgatgctcgccacgctgctgctgtcccagggaacgccgatgctgctggccggcgatgagcagggacacagccagcaggggaacaacaacgcctattgtcaggacaacgccaccacttggctcgactggtccacggcggatgacgcgctgaccgattacgtcgcggcgctgatcgcgctgcggcgacagatccccgctttgctgcaggacagctggtggcagcaggacgacggcagcgtgcagtggctgaacgcgcaagggcaaccgctcgacgcgcagcagtgggagcagggagagctgtacatgcagatcctgttgtcgcagcgctggctgctgctggtcaacgccacgtcgcaaacggtggaaatgaagttgccggcaggcgattggcacgttgtcgcccccttcattcaggaagactcacgggcggtactgcccgcctggcaccaggccgcgcgctcgctttgcgtactggtacggaaataa

SEQ ID NO: 2381 - DNA, 1989 bp, Serratia sp.
atgattgtactgacgcctggtaccgccgcgcctttaggtgcgcattacgacggtaacggcatcaattttaccctgttttctgcgcatgctacgcaggtggaattgtgtctgttcgatgcacaacaccgtgaaactcgtttgccattgcctgctcgcagcggtgatatctggcatggctacttgccgggaggcgagccggggcagcgttatggtttccgggtgcatggcccgttcgagccgcaacaagggctacggttcaacgccaacaagctgttgcttgacccggcagcccgtgcggttgaagggccggtcgctgatcatctgtatctgcacgggggctatgaccaaccggactctgaggacagcgcgccgctgatgccgaaatgcattgtgatcgacgagcgctacgattgggaagacgatcgacccccggcaacgccatggagcaagacggtggtctacgaagcccatgtgcgtgggctgacgttgctgcatccagacattccgccggtattacgcggcagctttgctgctcttgggcacccggtgatgattgcctatttcaagcgtctgggtattacggcgcttgagctgttgccggtgcagcagcacaccactgaaccgcgtttgcagcgcctgggattgatcaattactgggggtacaacgtgctggcgccttatgcgccggataaccgctatgccagcctgagaaccggtatgacgccgttacgcgaactccgcgacgcggtgaaggcgctgcataaagcagggattgaagtgattctcgatgtggtgttcaaccacagcgcagagttggatatcgatgggccaacgctatcactgcgtggcatcgataatccaagttattactggcttgaacctgaaggtggctacgttaatgccaccggctgcggtaatacgctgcggttggatcagccagcaggagtgacgtgggtgatggactgcctgcgtttttgggtacgcgaatgccatgttgacggtttccgtttcgatcttggcaccgtgttaggccgtacaccggcgtttgaccgcgatgcaccgctgtttcaggcgatgttggcggacgatacgctggggcgttgcaaactgatcgccgaaccttgggacattggccctggtggttatcaggttggcgcgtttcccggccgttttgccgaatggaatgaccactttcgtgacgatattcgccgtttttggttgcagggcgatctgtcactcggtcagttcgcccggcgttttgctgcctccagcgaggtcttcaaccaacgtgggcgggcaccttataccagcattaatatgctggcggcccacgatggctttaccttgcaggatgtggtgagttttaaccagaagcataaccaattgaacggcgaaggaaaccgtgatggtagtgaccataactttagctataaccacggtgttgaaggcccgagtgctgacaacgccattatacaacgacgcagagccagccagcgggcgcttcttgccacgttactcctggctcaaggaacgccgatgttgttggctggtgatgaacatggacatagtcaacaaggcaacagcaatgcttattgtcaggataacgaaaccacctggctcgactgggctacggcggacgattccctcaccgcatacactgccgcgctgatccgcctgcgccagcaaattcctgctttgcagcgggatggttggtggcaagagggagacggcagcgtgcagtggttgaatgtgcatgggcagccgctcagtgcgcaggagtgggaacagggcgatcggcttttgcagatccgcttatcacaacgctggctgctggtgatcaacgccacgccgcaagccgttgaaatgacgttacctgaggggacctggcaggctgttgccccctttattcaggacgattcgcaggcggttttacccgcctggtgccaggctgcgcattcgctttgcgtgctggtaaaaaagaacaattaa

SEQ ID NO: 2382 - DNA, 1983 bp, Serratia sp.
atgacggagctgacggccggcctcgccgcgccgctgggcgcgcattacgacggcgaaggcatcaactttaccctgtactcggcgcacgccgagcgggtggagctgtgcctgttcgacggccagcagcgcgaagtacgcctgccgctgccggcgcgcagcggcgatatctggcatggctatttgccgggcggcaggccggggcaacgttacggttaccgggtctatggcccgtttgatccgacgaacggacagcgtttcaaccccaacaaactggcgctcgatccggccgcgcgcgcggtggaagggccggtgggggaccacccgcacctgcacggcggttacgagcagccggacccgcacgacagcgcagagctaatgccgaaatgtgtggtggtggacgaacggtatgactggcaggacgatcgcccgcctgccacgccctggggccagacggtgatttatgaagcgcacgtgcgcggcctgacgctgctgcacccgaagatcccgccggcgctgcgcggcagcttcgccgcattggggcacccggcgatggtcgcccacttcaaacgcctcggcatcaccgcgctggaactgctgccggtgcagcaacatacctccgaaccgcgcctgcagcggttggggctgatcaactattggggctataacgtgctggcgccctatgcgccggacaaccgctacgccagcctgagcaccgagggcacgccgctgaatgaatttcgcgatgcggtcaaggcgctgcaccaagccggcatcgaggtgatcctcgacgtggtgtttaaccacagcgccgagctggatagggacgggccgatgctgtcgctgagcggcatcgataacctgagctactactggctgacgcccgaaggggactatgtcaacgacaccggctgcggcaacacgctgcggttggatcagccgcaaggcgtggcctgggtgatggattgcctgcgtttttgggtacgggagtgccacgtcgacggcttccgtttcgatctgggcagcgtgctcggccgcacgccggagttcgatcgcgatgccccgctgttccaggcgatgctggcggacgatgtgctgtcgcgctgcaagctcatcgctgaaccctgggacgttggccccggcggctatcaggtgggggcgtttcccggccgcttcgccgaatggaacgaccattaccgcgatgacatgcgccgtttctggctgcagagcggcgtgtcgctcggccagttcgcccggcgttttgccgcttccagcgatctgtataaccagcgcgggcgagcgccttacgccaccgtcaatatgctgaccgcccatgatggttttaccctgcaagacgtggtcagcttcaatgagaaacacaatcagcccaacggcgagggcaaccgcgacggcagcgatcgcaatttcagcaacaaccacggcgtcgaaggcctggtggccgacgacgccattgtacaacgccgcagggccagccagcgggcgatgctcgctacgctgttgctgtcccagggaacgccgatgctgctggccggcgatgaacagggacacagccagcaggggaacaacaatgcctattgtcaggacaacgccaccacctggctcgattgggccacggcggacgatgcgctaaccgattacgtcgcggcgctgatcgcgctgcgccgccagatccccgcgctgcagcaggaccgctggtggcagcaggatgacggcagcgtgcagtggctgaacgcgcaagggcaggcgctcgacgcgcagcagtgggagcagggcgagccgctcatgcagatcctgctgtcgcagcgctggctgctgctgatcaacgccacgccgcaaacgacggagatgaggttgccggaaggcgattggcaggttgtcgccccgttcactcaggaagactcacgggcggtattgcccgcctggcaccaggccgcgcgctcgctttgcgtactggtacggaaataa

SEQ ID NO: 2383 - DNA, 1986 bp, Serratia sp.
atggtagagctgacgccgggtcttgccgcgcctttaggggcttattacgacggtaatggcatcaactttaccctgttttctgcgcatgccactcaggttgagctgtgcctgttcgatgcgcaatatcgtgaaacacgcctgccgttgcctgcccgcagcggtgatatctggcatggatatctgccagggggcgagttggggcaacgttatggttttcgggtgcatggcccatttgagccgcatcttgggttgcgctttaacgccaacaagctgttgctcgatccggcggcgcgggcagtcgaagggccggttgccgaccatgtgcatttgcatggggggtacgatcaaccggacccgcaagacagcgccccgttgatgccaaaatgcatagtgatcgacgaaagctacgattggcaagacgatcgcccgccagccaccccttggggcaaaacggtgatctacgaagcccacgtccgggggctgacgttaacgcacccggagatcccggccgtattgcgtggcagctttgccgctcttggccacccggcgatgattgcctacttcaagcggttggggatcacggcgcttgagcttttgccggtgcaacagcacaccacggaaccgcgtttgcagcgcctggggctgatcaattactggggatacaacgtgctggctcctttcgcgccagacaaccgctacagcagtttgagcaccgggacgacgccgctgcgtgagttccgcgatgcggtgaaagcgctgcaccgggcggggatcgaagtgattctggacgtggtgttcaaccacagtgcagagctggatgtggatgggccaacgctgtcgctgcgcggtatcgataaccccagctactactggctaacccctgacggtggctacgataacctcaccggctgtggcaatacgctgcggttggatcagccggcgggcgtggcgtgggtgatggattgcctgcgcttttgggttcgggagtgccatgtcgacggttttcgcttcgatcttggcaccgtgttaggccgtacaccggcgtttgaccgcgatgcaccgctgtttcaggcgatgctggcggacgatacgctggggcgctgcaaactgatcgccgagccctgggacattggcccgggcggctatcaggttggcgcgtttccaggccgttttgctgagtggaatgaccatttccgtgacgatatccgccgtttctggctgcggggcgatctgtcactgggtcagtttgcccagcgttttgctgcctccagcgaggtattcaaccaacgtggacgcgcgccttatgtcagcatcaatatgctgacggcccacgacggctttaccttgcaggatgtagtgagtttcaaggagaaacataaccagcctaacggagagggaaaccgtgatggcagcgaccaaaactttagctgtaaccacggggttgaaggcctgattgctgacgaaaccgttttgcaacgccgccaggccagccagcgagcactgcttgccacgctgcttctggcgcaggggacaccgatgctgctggccggtgatgagcacggaaatagccagcaaggcaacaacaatgcttactgtcaggataacgcaaccacctggctcgactgggccaatgcggatgagtcactgaccgcctacaccgccgcgctgatccgcttgcgccagcaaattcctgctttgcaggcagaccgctggtggcaggagggagacggcagcgtgcagtggttaaacgcgcaggggcagccgctcagtgcgcaacagtgggaacagggcgatcgctgcttgcagatccgcctgtcgcaacgctggctgatggtgatcaacgccacccagcagaccgttgagatgacgttacccgagggtgattggcaggttgtcgccccctttactcaggaagattcacgggcggttctacccgccttgtgccaggttgcgcattcgctttgcgtgctggtagagaaaaattaa

SEQ ID NO: 2384 - DNA, 1986 bp, Serratia sp.
atggtagagctgacgccgggtcttgccgcgcctttaggggcttattacgacggtaatggcatcaactttaccctgttttctgcgcatgccactcaggttgagctgtgcctgttcgatgcgcaatatcgtgaaacacgcctgccgttgcctgcccgcagcggtgatatctggcatggatatctgccagggggcgagttggggcaacgttatggttttcgggtgcatggcccatttgagccgcatcttgggttgcgctttaacgccaacaagctgttgctcgatccggcggcgcgggctgtcgaagggccggttgccgaccatgtgcatttgcatggggggtacgatcaaccggatccgcaagacagcgccccgttgatgccaaaatgcatagtgatcgatgaaagctacgattggcaagacgatcgaccgccagccaccccttggggcaaaacggtgatctacgaagcccacgtccgggggctgacgttaacgcacccggagatcccggccgtattgcgtggcagctttgccgctcttggccacccggcgatgattgcctacttcaagcggttggggatcacggcgcttgagcttttgccggtgcagcagcacaccacggaaccgcgtttgcagcgcctgggtctgatcaattactggggatacaacgtgctggctcctttcgcgccagacaaccgttacagcagtttaagcaccgggacgacgccgctgcgtgagttccgcgatgcggtgaaagcgctgcaccgtgcagggatcgaagtgattctggacgtggtgttcaaccacagtgcagagctggatgtggatgggccaacattgtcgctgcgcggtatcgataaccccagctactactggctaacccctgacggtggctacgataacctcaccggctgtggcaatacgctgcggttggatcagccggcgggcgtggcgtgggtgatggattgcctgcgcttttgggttcgggagtgccatgtcgacggttttcgcttcgatcttggcaccgtgttaggccgtacaccggcgtttgaccgcaatgcaccgctgtttcaggcgatgctggcggacgatacgctggcgcgttgcaaactgattgccgagccctgggacattggcccggggggctatcaggttggcgcgtttccaggtcgttttgctgagtggaatgaccatttccgtgacgatatccgccgtttctggctgcggggcgatctgtcactgggtcggtttgcccagcgttttgctgcctccagcgaggtattcaaccaacgtgggcgcgcgccttatgtcagcatcaatatgctgacggcccacgacggctttaccttgcaggatgtagtgagtttcaaggagaaacataaccagcctaacggagagggaaaccgtgatggcagcgaccaaaactttagctgtaaccacggggttgaaggcctgattgccgacgaaaccgttttgcaacgccgccaggccagccagcgagcactgcttgccacgctgcttctggcgcaggggacaccgatgctgctggccggtgatgagcacggaaatagccagcaaggcaacaacaatgcttactgtcaggataacgcaaccacctggctcgactgggccaatgcggatgagtcgctgaccgcatacaccgccgcgctgatccgcttgcgccagcaaattcctgctttgcaggcagaccgctggtggcaggagggagacggcagcgtgcagtggttaaacgcgcaggggcagccgctcagtgcgcaacagtgggaacagggcgatcgctgcttgcagatccgcctgtcgcaacgctggctgatggtgatcaacgccacccagcagaccgttgagatgacgttacccgagggtgattggcaggttgtcgccccctttactcaggaagattcacgggcggttctacccgcctggtgccaggttgcgcattcgctttgcgtgctggtagagaaaaattaa

SEQ ID NO: 2385 - DNA, 1986 bp, Serratia sp.
atgatcgagctgacgcctggtctcgccgcgcctctaggggcttgttacgacggcaatggcatcaactttaccctgttttccgcgcatgccacgcaggtagagctgtgcctgttcgacgcacagcatcgtgaaacgcgtataccgctgcctgcgcgcagcggtgacatttggcacggctatttgcctggaggggaaccggggcagcgttacggttttcgggtgcatggcccgttcgagccgcataaagggcgacgctttaacgccaacaaactgttgctcgatccagccgcccgggcggtagaagggccggttgccgatcacctgcatctgcatggagggtacgatcatccggatcctcaggacagcgccccgctgatgccaaaatgtgtggtgatcgaccagcgttatgattgggaagacgaccgaccgcctgcgacgccctggagccagacggtgatctatgaagcccacgttcgggggctgacgttattgcatccggagatcccggccgtgttgcgtggcagttttgccgcaataggccacccggtaatgatcgcctatttcaagcggctggggatcacggcgcttgagttgttgccggttcagcagcataccaccgagccgcgtctgcaacgcctggggctgattaattactggggatacaacgttctggcgccttacgcgccggacaaccgttattgcagcctgagcactgatatgacgccgctgcgtgagtttcgcgatgcggtgaaagcgctacacaaagcggggatcgaagtgattctggatgtggttttcaaccacagtgcggagctggacgttgatgggccgacgttatcgctgcgcggcatcgataacgagagttactactggctaacccctgaaggtgattacgataacgtcaccggctgcggcaatacgctgcggttggatcagccggtaggtgttgcgtgggtcatggattgcctacgtttttgggtacacgaatgccatgtcgacggcttccgcttcgatcttggcaccgtgttgggccgtacgccggcatttgaccgtgacgcgccgctgtttcaggcgatgctggcggacgatacgctggggcgttgcaaactgatcgccgaaccttgggacattggccctggcggatatcaggttggggcgtttcctggccgctttgctgagtggaatgaccattttcgtgacgacatccggcgtttctggttgcagaacgacctgtcacttggccggttcgcccagcgttttgccgcctccagcgaggtattcaaccaacgtgggcgagcgccctatgccagcatcaatatgctgactgcccacgacggttttaccttgcaggacgtggtgagtttcaacgagaagcacaatcagccgaacggcgaaggaaaccgcgatggcagtgaccgtaactttagctgtaaccacggtattgaaggcctgattgccgacgataccgttttgcaacaccgcaaggccagtcagcgggcgcttcttgccacgctgcttctggctcaaggaacaccgatgctgctggccggtgatgagcatggacatagccagcaaggcaacaacaacgcttactgtcaggataacgaaaccacctggctcgactgggccaaggcggatgactcactcaccgcatacaccgccgcgctgatccgcttgcgccagcaaattcctgccctgcgggaagatcgctggtggcaggagggagacggcagcgtgcagtggttgaacgcgcaagggcaaccgctcagcgtgcaagagtgggaacagggcgatcggcatatgcagatccgcctgtcgcaacactggttgctggtgatcaacgccacgcagcaagccgttgagatgacgttacctgagggtgattggcaggttgtcgccccctttactcaggacgattcgcgggcggtttcccccgtctggtgccaggctgcgcattctctttgcgtgctggcagagaaaaattaa

SEQ ID NO: 2386 - DNA, 1986 bp, Serratia sp.
atggtagagctgacgccgggtcttgccgcgcctttaggggcttgttacgacggtaatggcatcaactttaccctgttttctgcacatgccacgcaggtcgaactgtgcctgttcgatgcgcaatatcgtgaaacacgcctgccgttgcctgcccgcagcggtgatatctggcacggatatctgccggggggcgagccggggcaacgctatggttttcgggtgcacggcccgtttgagccgcatcttgggttgcgctttaacgccaacaagctgctgctcgatccggcggcacgggcggtagaaggcccggtggccgaccatgtgcatttgcacgggggatacgatcaacaggatccacaagacagcgccccgttgacgcctaaatgcgtggtgatcgatgaaagttacgattggcaggacgatcgcccgccagccaccccttggggcaaaacggtgatctacgaagcgcatgtccgggggctgacgttaacgcacccggagatcccggccgtattgcgtggcagttttgctgccttgggccacccggcgatgattgcctacttcaagcggttagggatcaccgcgcttgagctactgccggtgcaacagcacaccacggaaccgcgcctgcagcgcctgggattgatcaattactggggctacaacgtgttggctccttttgcgccagataaccgttatagcagtttgagcaccggtacaacgccgttgcgtgaattccgcgatgcggtgaaagcgctgcaccgggcgggaattgaagtgatcctggacgtggtattcaaccacagtgccgagctggatgtggatgggccaacgctgtcgctgcgcgggatcgacaacaccagttactactggctaaccccagacggtgattacgataacctcaccggctgtggcaacacgttgcgcctggatcagccagcaggtgtggcgtgggtgatggattgtctgcgcttttgggtgcgggagtgccatgtcgacggcttccgcttcgatcttggcaccgtgttgggccgcacaccagcgtttgaccgtgatgcaccgctgtttcaggcgatgctggcggacgatacgctggggcgctgcaaactgatcgccgagccttgggacattggcccgggcgggtatcaggtcggcgagtttcctggccggtttgccgagtggaatgaccattttcgtgacgatatccgccgtttctggctgcggaacgatctgacactgggccagtttgcccagcgttttgccgcttccagcgaggtattcaaccaacgtgggcgcgcgcccaatgccagcatcaacatgctgacggcccacgacggctttaccttgcaggacgtagtgagtttcaaggagaagcataaccagccgaacggagagggaaaccgtgacggcagtgaccaaaactatagctgtaaccacggggttgaaggcctgattgccgacgaaaccgtcttgcaacgccgccaggccagccagcgagcactgcttgccacgctgcttctggcacaggggacaccgatgctgctggccggtgatgagcacggaaatagccagcagggcaacaacaatgcttactgtcaggataacgaaaccacctggctcgattgggccaatgcggatgattcactgaccgcatacaccgccgcgctgatccgcttgcgccagcaaattcctgccttgcaggcagaccgctggtggcaggagggagacggcagcgtgcagtggttgaacgcgcaggggcagccgctcagtgcgcaacagtgggaacagggcgatcgctgcatgcagatccgcctgtcgcaacgctggctgatggtgatcaacgccacgcagcaggccgttgagatgacgttacccgagggtgattggcaggttgtcgccccctttactcaggaaccttcgcaggcggttttacccgcctggtgccaggctgcgcattcgctttgcgtgctggtagagaacaattaa

SEQ ID NO: 2387 - DNA, 1977 bp, Serratia sp.
atgagggaattgcaacccggtgttgccgccccttacggcgcccatttcgacggcagtggcgtcaacttcgtgctgttttcagccaatgccacgcgggtggagctgtgcctgtttgatgccgagcagcgtgaaacccgcctgccgttaccggcgcgcagcggcgatatctggcacggttatctgccgggaggtcggccgggcctgcgttacgcttatcgggtgcacggcccgtttgcgccggcgcaggggttgcgtttcaatccgcaaaaactgctgctggatccggccgcccgcgcggtcgaaggcccggttgacgacgatcctcggctgcacggtggttatcagcaggccgatgaacacgacagcgcgaccctgatgcccaaatgtatcgtggtggatgagacctacgattggcaggacgatcgcgcgccggccacgccgtggggagaaacggtgatttacgaagcccatgtgcgcggtctgacgctgcaacacccggcgatcccgccggcgctgcgcggcagctttgcggcattgggtcacccggcgatgatcgcctacttcactcacttgggcattactgcgctagagctgttgccagtccagcaacataccaccgagccacgcttgcagcagctcgggctacagaactactggggctataacgtgctggcgccgtacgcgccggatcatcgctatgccagccagtcgtcgccgttgcgcgagttccgcgacgcggtaaaagccctgcatcgcgccggtattgaagtgattctggacgtggtgtttaaccacagcgccgagctggatatcgacgggccgacgctgtcgctgcgcggtatcgacaacccgagctattactggctgaacccggacggcgactataccaacgtcaccggctgcggcaacacgctgcggcttgaccaaccgtcgggcgtggcatgggtgatggattgcctgcgtttttgggcgcgcgagtgccacgtcgacggctttcgtttcgatttgggcacggtcttgggccgcaggccagcattcgatcgtgacgcgccgctgtttcaggcgatgctggcggacgacaccctgtcccgctgcaagctgatcgccgaaccttgggatatcggcccgggcggctatcaggtggggggggttcccggtcgttttgccgagtggaacgaccactatcgtgacgatatgcggcgtttctggctgctgggcgacttgccgcttggcgcattcgcccagcgctttgccgcctccagcgaggtgtttgaccggcgtggccgggcaccctatgccagcgtcaacatgctcaccgcccacgacggctttaccctgcaggatctggtgagctacaaccagcggcacaaccagccgaacggcgaagacaaccgtgacggcaacgggcgtaattacagctataaccacggcgtggaagggccaaccgatgatgccgaggtgaggcagcgccgcggtcgcagccaacgagcgctacttgccacgctgttgctgtcgcagggcacgccgatgctgttggctggcgacgagcatggtcacagccagcacggtaacaacaacgcctattgccaggataatgccactacctggctggactggcagtcggcggatcgggcgctgctcgactataccgctgcactgatccgcctgcggcgacaaattcccgccctgcgtcaggatcgctggtggcaggagggggatggctgcgtgcaatggctgaatgcgcagggccagccgcttggcgcatcgcagtgggagcatgcgccaccacagctgcaaattcggctgtcccaacgttggctggtggtgattaatgccggccccgagacggtcgatatgaccttgcctgccggcgattggcagctagtcaccccgtttgttcaggaagactcgcaggcggatttgcccgcctggcgccagcctgcgcactcgctttgcgtactggcagacaataattaa

SEQ ID NO: 2388 - DNA, 2004 bp, Serratia sp.
atgatggatctgatgccgggtcttgctgcgcccttaggggcttattatgacggtaatggcatcaattttaccttgttttccgcccatgccacaggggttgagctttgtctgttcgatgagcagcatcgtgagacgcggataccactccccgcgcgcagcggggatatttggcatgggtatctgccaggggggaggccggggctacgttatggctaccgggttcatgggccatttaaaccgcaacaagggttgcggtttaatgccaacaagctgttgcttgacccggccgcccgatcagtagaaggacctgtcgctgatcacccctctctgcatggcggtcatgatctgcccgacccacacgatagtgctgcgttgatgccaaagtgcatcgtgatcgacgaaagttatgactggcaagatgatcgtccgcccgtcacgccttggagcaaaacggtgctttatgaagcccatgtcagagggttgacgttattgcatccgcagatcccagaagagttgcgcggcagttttgccgccctgggtcacccggtaatgatcaactacttcaagcgattggggatcaccgcgcttgaactgttgccgatacagcagcacaccacggaaccccgtctacaacgcatggagctgaccaactactggggatataacgtgttggcgccttacgcaccaaacaatcgttattgcagtttgagcagcaagatgacgccgctgcgtgaatttcgcgatgcggtaaaagcactgcacaaagccgggatagaagtgattctggatgtggtgtttaaccatagtgcagaactggatgcttatgggcccaccttgtcgtttcgcggcattgataacctgagttattactggctcaccgccgatggcgatttcgagaacgtcacgggttgcggcaatacgttgcgtttggatcagcctgccggtgtggcctgggtgatggattgcctgcgtttttgggtgcgtgaatgtcatgtggatggttttcgctttgatctcggtacggtgttggggcgtatccctgagtttgagcgggatgcaccactgtttcaggcgatgctggcagacgatacgctgggtcgttgtaagttgattgctgaaccttgggatatcgggccggaagggtatcagcttggggcgtttcctggtcggtttgccgagtggaatgaccattttcgtgatgatattcgcagcttctggttgaaaaacgatcggccactggggcagtttgcccaacgttttgccgcttccagcgacatatttgatctgcgtgggcgcgcgccttatgcctgcatcaatctgctggcggctcatgatggttttacgctgcgcgatgcggtgagttttaaccacaagcataatcaacttaatggtgagaacaaccgtgatggtcatgactataactttagtaataatcatggggttgaaggcaatggtgtcgaaggactgattgccgaccaagctgttttacagcgccgtagaaatagccaacgcgtgctgcttgccacgttgttgctggcccagggaacaccgatgctgttggcgggcgatgagcatggtcatagtcagcaggggaataacaatgcgtattgtcaggataacgctatcacttggctcgattgggccaaagcagatgattctcttactgaatacaccgcggccttgatccgcttgcgccagcagatccccgctttgcaggggggaacctggtggcaggagggggacggtaacgtacagtggttaaacgcacaaggccaaccactgaaggtgcaagagtgggaagacctggacgggcagcatatacagatcctcctttcacaacattggttgctgctgattaacgcgacagcgaaagctgtggagatgacactccctgagggggattggcagccagttccccctttcacgcaggaatattcattggttgatttaccctcttggtgccaggttgcgcattctctttgtgtgctggcaaggaaaaattaa

SEQ ID NO: 2389 - DNA, 354 bp, Streptomyces sp.
gtgttctcgaggacgatgaataccgtacgcacgacggccatggcgctcgccgcggccaccgcgttcaccctggtgggacctgcgggttccgcctccgccatcgaccacgtcacctgtgacccggaccgcggatatctgaagatctggtcgcacctgaacgggcgcgacagcgtggactgctacgcgaatcgcggcaagaccaacttcggcaactggtgggtcgacaagatctccaccggaaacaacgtcgtgaagtactacgacgccaatggcgatgtcgtcaagatcggccgcaacaaagtgatttcgtacccgaaccgcccgccgaaggtcaaggccatcgaaattctctga

SEQ ID NO: 2390 - DNA, 339 bp, Streptomyces sp.
atgaataccgtacgcgcgacggccatggcgctcgccgcggccaccgcgttcaccctggtgggacctgcgggttccgcctccgccatcgaccacgtcacctgtgacccgggccgcggatatctgaagatctggtcgcacctgaacgggcgcgacagcgtggactgctacgcgaatcgcggcaagaccaacttcggcaactggtgggtcgacaagatctcgaccggaaacaacgtcgtgaagtactacgacgccaatggcgatgtcgtcaagatcggccgcaacaaagtgatttcgtacccgaaccgcccgccgaaggtcaaggccatcgaaattctctga

SEQ ID NO: 2391 - DNA, 339 bp, Streptomyces sp.
atgaataccgtacgcacgacggccatggcgctcgccgcggccaccgcgttcaccctggtggggcctgcgggttccgcctccgccatcgaccacgtcacctgtgacccggaccgcggatatctgaagatctggtcgcacctgaacgggcgcgacagcgtagactgctacgcgaatcgcggcaagaccaacttcggcaactggtgggtcgacaagatctccaccggaaacaacgtcgtgaagtactacgacgccaatggcgatgtcgtcaagatcggccgcaacaaagtgatttcgtacccgaaccgcccgccgaaggtcaaggccatcgaaattctctga

SEQ ID NO: 2392 - DNA, 339 bp, Streptomyces sp.
atgaataccgtacgcacgacggccatggcgctcgccgcggccaccgcgttcaccctggtgggacccgcgggttccgcctccgccatcgaccacgtcacctgtgacccggaccgcggatatctgaagatctggtcgcacctgaacgggcgcgacagcgtggactgctacgcgaatcgcggcaagaccaacttcggcaactggtgggtcgacaagatctccaccggaaataacgtcgtgaagtactacgacgccaatggcgatgtcgtcaaggtcggccgcaacaaagtgatttcgtacccgaaccgcccgccgaaggtcaaggccatcgaaattctctga

SEQ ID NO: 2393 - DNA, 321 bp, Streptomyces sp.
atggcgatggcgctcgcggcagcggccgctttcaccatgacggggccggccacgaccgcgtccgcaatcaacaaggtcacctgcaaccccggcgcagggtacttgaagatctggtcgcacatgaacggtcgtgacagcgtggactgctacgcgaaccgaggaaagaccaacttcggaaactggtgggtcgacaagatctccaccggaaacaacgatgtgaagtactacgacgccaacggcgacgtggtgaagatcaaccgaggcaagaccatcagctacccgaaccgcccaccgaaggtcaaggcgatcgaaatcctctag

SEQ ID NO: 2394 - DNA, 315 bp, Streptomyces sp.
atggcgctcgccgcggccaccgcgttcaccctggtgggacccgcgggttccgcctccgccatcgaccacgtcacctgtgacccgggccgcggatatctgaagatctggtcgcacctgaacgggcgcgacagcgtggactgctacgcgaatcgcggcaagaccaacttcggcaactggtgggtcgacaagatctccaccggaaacaacgtcgtgaagtactacgacgccaatggcgatgtcgtcaagatcggccgcaacaaagtgatttcgtacccgaaccgcccgccgaaggtcaaggccatcgaaattctctga

SEQ ID NO: 2395 - DNA, 315 bp, Streptomyces sp.
atggcgctcgccgcggccaccgcgttcaccctggtgggacctgcgggttccgcctccgccatcgaccacgtcacctgtgacccgggccgcggatatctgaagatctggtcgcacctgaacgggcgcgacagcgtggactgctacgcgaatcgcggcaagaccaacttcggcaactggtgggtcgacaagatctccaccggaaacaacgtcgtgaagtactacgacgccaatggcgatgtcgtcaagatcggccgcaacaaagtgatttcgtacccgaaccgccctccgaaggtcaaggccatcgaaattctctga

SEQ ID NO: 2396 - DNA, 351 bp, Streptomyces sp.
atgttctccatgacgaggaacgccccgcgcaccctggccgcggcgctggccgcagccgccgccttcaccctgggcggtccggtcgccacggcctccgccatcgaccatgtcacctgcgaccccgacgcggggttcctgaagatctggtcgcacaacaacgggcgtcagagcgtggactgctacgcgaaccgcgggaagaccgacttcggcggctggtgggtcgaccagatctccaccggcaacaacgacgtcaagtactacgacgccaacggcgacgtcgtgaagatcgcccgatggagcaacgtcaagtacaacaacacgccgaaggtcaaggccatcgaaattctgtag

SEQ ID NO: 2397 - DNA, 321 bp, Streptomyces sp.
atggccatggcgctcgccgcggccacggcgttcaccatggtgggacctgcgggttccgcctccgcgatcgatcacgtcacctgtgacccggaccgcgggtatctgaaggtctggtcgcacctgaacgggcgcgacagcgtggactgctacgcgaatcgcggcaagaccgacttcggcaactggtgggtcgacaagatctccaccggaaacaacgtcgtgaagtattacgacgccaacggtgatgtcgtcaagatcgaccgcaacaaggtgatttcgtacccgaaccgcccgccgaaggtcaaggccatcgaaattctctga

SEQ ID NO: 2398 - DNA, 351 bp, Streptomyces sp.
atgttctcaaggacgaggaacgttccgcgcaccctggccctggcactggcggccgccgcggcgttcaccctcggcgggccgctcaccaccgcctccgccatcgaccacgtcacctgtgacccggacgccggcttcctgaagatctggtcgcacagcaacgggcgccagagcgtggactgctacgcgaaccggggcaagaccgacttcggcggatggtgggtcgaccagatctccaccgggaacaacgacgtgaagtactacgacgccaacggcgacgtcgtgaagatcgcccggtggagcaacgtcaagtacaacaacacaccgaaggtcaaggccatcgagatcctgtag

SEQ ID NO: 2399 - DNA, 474 bp, Streptomyces sp.
atgactgagcggaatcgagtcccgtccctgctctcccgggccggcgcggtctcggccctctccctcgccgcgatgagcaccaccctggtcgcccccggcgcggcgcccgaggcggcggcggccacccacgccgccaaggcgctccagatcgcctcctcgaagaagggctcgccctaccggtacggcgcgaccggcccccgcagcttcgactgctccgggctgacgctctactcgtacaagaaggccgggaagaagctgccacggacggcggcgcagcagcacaaccggaccaaacggatctccgcctcccaccggcgcaagggcgacctggtcttcttccactccggcggcagcgtctaccacgtgggcatctacgccgggggcggcaagatctggcactcccccaagagcggcgcggtggtgcggctggagaagatctggaccggcagcgtgcggtacgggcgcgtgaactga

SEQ ID NO: 2400 - DNA, 474 bp, Streptomyces sp.
atgactgagcggaatcgagtcccgtccctgctctcccgggccggcgcggtctcggccctctccctcgccgcgatgagcaccaccctggtcgcccccggcgcggcgcccgaggcggcggctgccacccacgccgccaaggcgctccaggtcgcctcctcgaagaagggctcgccctaccggtacggcgcgaccggcccccgcagcttcgactgctcggggctgacgctctactcgtacaagaaggccgggaagaagctgccacggacggcggcgcagcagcacaaccggaccaaacggatctccgcctcccaccggcgcaagggcgacctggtcttcttccactccggcggcagcgtctaccacgtgggcatctacgccgggggcggcaagatctggcactcccccaagagcggcgcggtggtgcggctggagaagatctggaccggcagcgtgcggtacgggcgcgtgaactga

SEQ ID NO: 2401 - DNA, 474 bp, Streptomyces sp.
atgactgagcggaatcgggtcccgtccctgctctcccgggccggcgcggtctcggccctctccctcgccgcgatgagcacctccctggtcgctcccggcgccgcacccgaggcggcggcggccacccacgccgccaaggcgctcaagatcgcctcctcgaagaagggctcgccctaccggtacggcgcgaccggcccccgcagcttcgactgctcgggcctgacgctctactcgtacaagaaggccgggaagaagctgccacggacggcggcgcagcagcacaaccggaccaaacggatctccacctccaaccggcgcaagggcgacctggtcttcttccactccggcggcagcgtctaccacgtgggcatctacgccgggggcggcaggatctggcactcccccaagagcggcgcggtggtgcggctggagaagatctggaccggcagcgtgcggtacgggcgggtgaactga

SEQ ID NO: 2402 - DNA, 474 bp, Streptomyces sp.
atgactgcgctcaatcgtgtcccgtcgctcatggcccgggccggcaccgcctcggcgctcaccatcgccgcggtgagcggctccatcgtggcgcccggcttcgcatccgaagccgctgccgccacaccggcgaccaaggcactccagatagcggcctccaagaaaggttccccctacaggtacggggccaccggtccgcaccggttcgactgctccgggctcacgctctactcgttcaagaaggccggcaagaagctcccccgcacggctgcccagcagtacaacaagacgcaccacatctccgccaagaaccgcaaggcgggcgacctggtgttcttccactcgggcagcaacgtgtaccacgtcggtatctacgcgggtaagaacaagctctggcactccccgaagagcggggacgtggtgcgactgcagaagatctggaccaagagtgtctggtacggacgcgtgaagtga

SEQ ID NO: 2403 - DNA, 474 bp, Streptomyces sp.
atgactgcgctcaatcgtgtcccgtcgctcatggcgcgggtcggcacggcctcggcgctcaccatcgccgcgatgggcggctccatcgtggcgcccggcttcgcatccgaggccgcggcggccacaccggcgaccaaggcactccagatagcggcctccaagaagggttcgccctacaggtacggggccaccggtccgcaccggttcgactgctccgggctcacgctctactcgttcaagaaggccggcaagaagctcccccgcacggctgcccagcagtacaacaagacgcgccacatctccgccaagaaccgcaaggcgggcgacctggtgttcttccactcgggcagcaacgtgtaccacgtcggtatctacgcgggtaagaacaagctctggcactccccgaagagcggggacgtggtgcggctgcagaagatctggaccaagagtgtctggtacggacgcgtgaagtga

SEQ ID NO: 2404 - DNA, 477 bp, Microtetraspora sp.
atgactgcgcagatgcatgtcccgtccctgctgtcccgggcgggagccgtctcggctctcaccctcgccgccgtcggcggcacgctcctcgcaccgggagcggcacccgaggcccaggcagccaccacgcacgcagcgaaggcactcagcgtcgccgcggccaagaagggcgcaccgtaccggtacggcgcggcgggcccctcccgcttcgactgctccgggctcacgctctacgcgtacaagaaggcgggcaagtcgctgccccgcaccgcgcagcagcagtacaacaagacccggcacatctccgcctccagccggcagaagggcgacctggtcttcttccactccggcggccgcgtctaccacgtcgggatctacgccggcagcggcaagatctggcactcccccaagaccggctcctgggtgaagctcgacaagatctggacctccaaggtctcctacggccgcgtccgctga

SEQ ID NO: 2405 - DNA, 474 bp, Streptomyces sp.
atgactgcgctcaatcgtgtcccgtcgctgatggcccgggccggaaccgcctcggccctcaccctggccgccgtcggcggctcgatcgcggtaccgggactggccaccgaggcctccgccgcgaccaccgcgacgaaggcgctccagatcgcggcgtccaagaagggctcgccgtacagctacggggccaccggaccgcgccggttcgactgctcggggctcacgctctactcgttcaagaaggcgggcaagaagctgccccgcaccgccgcccagcagtacaacaggacgcaccacatttcgtccggccaccgcaaggcgggcgacctggtgttcttccactcggggtccagcgtctaccacgtcgggatctacgccggtaagggcaagatctggcacgccccgaagaccggggacgtggtgcgcctgcagaagatctggaccaagagcgtctggtacggccgggtgaactga

SEQ ID NO: 2406 - DNA, 477 bp, Streptomyces sp.
atgactgcgcagatgcacgtcccgtccctgctgtcccgggccggagccgtctcggctctcaccctcgccgccgtcggcggcacgctgctcgcaccaggagcggcgccggaggcccaggcagcgaccgcacacgcgaacaaggcactgagcgtcgccgcggccaagaaaggatcgccgtacgggtacggagccaccggacccaccaggttcgactgctccggtctgacgctctacgcgtacaagaaggcgggcaagtggctgccccgcaccgcgcagcagcagtacaacaagacccggcacatctccgcgtccagcagacaacagggggacctggtcttcttccactccggtggaagggtctaccacgtgggcatctacgccggcggcggcaagatctggcactcgcccaagacgggctcctgggtgaagctcgacaagatctggtcgtcgaaggtctactacggccgcgtccgctga

SEQ ID NO: 2407 - DNA, 474 bp, Streptomyces sp.
atgactgcgctcaatcgcgtcccgtccctcatggcccgcgccggcacggcctcggccctcaccctcgccgccgtcgggggctcgatcgtgatccccggcgcggccaacgaggcctcggccgcggccttggcgacgaaggcgctccagatcgccgcgtccaagaagggctccccctaccagtggggagcgaccggcccgcggaggttcgactgctccgggctcaccctgtactcgttcaagaaggcgggcaagaagctgccccgcacggccgcccagcagtacaacaagacccgccacatctccgcgcgcagccgccgcgccggcgacctggtgttcttccactcgggttcgaacgtgtaccacgtcggcatctacgcgggcgccggcaagatctggcacgcgccgcacaccgggaccgtggtcaagctggagaagatctggaccaggagcgtctggtacgggcgggtcaactga

SEQ ID NO: 2408 - DNA, 553 bp, Streptomyces sp.
gtgaagccgcatccgcggccgggcaacttcgccagcccgaatccgacaggtcatccttcacaggcggctgacgaagggttgcgcatgactgcgctcaatcgtgtcccgtcgctgttgacccgggccggtacggcctcggctctgaccatcgccgccgtgggcggcagcatcgtggtcccgggcgtcgcatccgacgccgaggccgccaccgtggcgtcgaaggcactcaaggtcgcggcttccaagaagggctcgccctaccggtggggcgccacgggtcccagcaggttcgactgctcggggctgacgctctactcgttcaagaaggcgggcaagaagctgccccggacggcccagcagcagtacaacaagacgaagcacatctccgcgagcaaccgcaagctcggagacctcgtcttcttccactcgggctcgagcgtctaccacgtcggtatctacgcggggaagggaaagatctggcactcgccgaagaccggtgacgtcgtccggctccagaagatctggacgaagagcgtctggtacggccgagtcc

SEQ ID NO: 2409 - DNA, 477 bp, Streptomyces sp.
atgactgcgcagatgcatgtcccgtctctgctgtcccgggcgggagccgtctcggctctcaccctcgccgccgtcggcggcacgctcctcgcaccgggagcggcacccgaagcccaggcagccaccacgcacgcgacgaaggcactcaacgtcgccgcggccaagaagggcgcgccctaccggtacggctcggcgggtcccacccgcttcgactgctccgggctcacgctctacgcgtacaagaaggcgggcaagtcgctgccccgcaccgcgcagcagcagtacaacaagacccggcacatctccgcctccagccggcagaagggcgacctggtcttcttccactccggcggccgggtctaccacgtggggatctacgccggcagcggcaagatctggcattcgcccaagacggggtcctgggtgaagctcgacaagatctggacctcgaaggtctactacggccgcgtgcgctga

SEQ ID NO: 2410 - DNA, 474 bp, Streptomyces sp.
atgactgcgctcaatcgtgtcccgtccctcatggtccgggccggtacggcctcggccctcaccatcgccgctgtgggcggctcgatcgcggtgcccggcgtcgcctccgaggccgccgcggcgaccccggcgacgaaggcgctgcagatcgcggcctccaagaagggcgcaccgtaccggtacggcgccaccgggccctaccggttcgactgctcggggctgacgctgtactcgttcaagaaggccggcaagaagctgccgcgcaccgccgcccagcagtacaacaagacccgtcacatctccgccaagagccgcaaggcaggggatctggtcttcttccactcgggccggagcgtgtaccacgtcggcatctacgccgggaagggaaagatctggcacgcgccgaagaccggtgacgtggtgaggctgcagaagatctggaccaagagcgtctggtacggccgggtcaagtga

SEQ ID NO: 2411 - DNA, 477 bp, Streptomyces sp.
atgaccgcgcagattcatgtcccgtctctgctgtcccgtgccggcgccgtgtcggcactcaccctcgccgccgtcggcggcacgatgctggcgcccggcgccgtgtcggaagccgaggccgcgcccgctcacgccaccaaggcgctgaacgtggccgcctccaagaagggtgcaccgtacaagtacggagcggcgggcccgtcccggttcgactgctccggcctgacgctctactcgtacaagaaggccggcaagaccctgccgcgcaccgcgcagcagcagtacaacaagacgcgtcacctgtcggcgtcgagccggcagaagggtgacctcgtcttcttccactccggcggcagcgtgtaccacgtcggcatctacgccggcgggaacaagatctggcactcgccgaagtccggatcggtggtgaagctggaccgcatctggtcgaagtcggtgtactacggccgcgtgcgctga

SEQ ID NO: 2412 - DNA, 474 bp, Streptomyces sp.
atgactgcgctcaatcgtgtcccgtcgctgtggacccgggccggtacggcctcggctctgaccatcgccgccgtcggcggcaccctggtggtcccgggcgtcgctcccgacgccgaggcggccaccgtggcgacgaaggcactccaggtcgcggcctcgaagaagggcgccccctacaagtggggggccaccggaccgcgtcgcttcgactgctccgggctgaccctgtactcgttcaagaaggcgggcaagaatctccctcgaacggccgcggcgcagtacaacaagacccaccacatctcggcctcgcaccgcaaggccggagacctggtgttcttccactcgggccggagcgtgtaccacgtcggcatctacgccgggaagggaaagatctggcactccccgaagaccggggacgtcgtgaagctgcagaagatctggacgaggagcgtctggtacggacgggtgagctga

SEQ ID NO: 2413 - DNA, 477 bp, Streptomyces sp.
atgactgcgcagacacatctcccgtccctgctgtcccggacgggtgccgtctcggcactcacgatcgccgccgtcggcggctcgctgatcgtgccgggcggcgcacctgaggcgcacgccgcctcggctcacgcgacgaaggctctcaaggtcgccgcgtcgaagaagggagccccgtacgggtacggagccaccggtccgaaccgtttcgactgctcggggctcacgctctacgcctacaagaaggcgggcaagaagctgccccgcacggcccagcagcagtacaaccgcacccgccatatctccgcatcccagcgcgagcgcggtgacctggtgttcttccactcgcgtgggtacgtctaccacgtcggcatctacgccggggcggggaagatctggcactcgcccaagagcggctccgtcgtgaagctgaccaagatctggtccaagagcgtccgctacggacgggtgcgctag

SEQ ID NO: 2414 - DNA, 474 bp, unknown
  environmental sample
atgactgcgctgaatcgtgtcccgtcgctgttgacccgggccggcacggcctcggctctgaccatcgccgctgtcagcggcagcatcgtggtcccgggcgccgcatccggcgccgaggccgccacggtggcgtcgaaggcactcaaggtcgcggcttccaagaagggctccccttacaagtacggcgccgtgggcccgagcaggttcgactgctcagggctgacgctctactcgttcaagaaggcgggcaagaagctgccccgtactgctcagcagcagtacaacaagacgaagcacatctccgcgagcagccgcaagctcggagacctcgtcttcttccactcgggctcgaacgtctaccacgtcggtatctacgcggggaagggaaagatctggcactcgccgaagacgggtgacgtcgtccggctgcagaagctgtggacgaagaacgtctggtacggccgggtccgctga

SEQ ID NO: 2415 - DNA, 744 bp, Streptomyces sp.
atgtcgtgggtcaagatccctgtcgacgacaagcccccgccaccgcggcggggcggtccgggcggacgccgagtcctgccgctgtcccggacgtctggtcgacaggagtggatcggcaggagtggaggacccaatcagtacggggcgttcgcgctgtcacgacagcgagggccgtcccttggggtgaagccgcagccgcggccgggcatcttcgccagcccgaacccgacaggtcatccttcgcaggcggctgacgaagggttgcgcatgaccgcgcagatgcatgtcccgtccctgctgtcccgggccggagccgtctcggctctcaccctcgccgccgtcggcggcacgctgttcgcaccaggtgcggcaccggaggcccaggcagcgacgacgcacgcgaacaaggcactgagcgtcgccgtgtcgaagaagggagcgccctaccggtacggatccgccggaccctcgcggttcgactgctccggcctgacgctctacgcgtacaagaaggcgggcaagtcgctgccacgcaccgcgcagcagcagtacaacaagacccggcacatctccaaggccagcagacagaagggggacctggtcttcttccactccggtgggaaggtgtaccacgtcggcatctacgccggcagcggcaagatctggcactcgcccaagacgggttcctgggtgaagctcgacaggatctggtcgtcgaaggtctactacggccgcgtccgatga

SEQ ID NO: 2416 - DNA, 477 bp, Streptomyces sp.
atgaccgcgcagatgcacgtcccgtccctgctgtcccgggccggagccgtctcggctctcaccctcgccgccgtcggcggcacgctgttcgcaccaggtgcggcatcggaggcccaggcggcgacgacacacgcgaacaaggcactgaccgtcgccgcgtccaagaagggcgctccctaccggtacggatccatcggacccacccggttcgactgctccggtctgacgctctacgcgtacaagaaggcgggcaagtcgctgccccgcaccgcgcagcagcagtacaacaagacccggcacatctcctcggccagccggcagaagggggacctggtcttcttccactccggtgggagggtctaccacgtcggcatctacgccggcagcggcaagatctggcactcgcccaagacgggctcctgggtgaagctcgacaagatctggtcgtcgaaggtctactacggccgcgtccggtga

SEQ ID NO: 2417 - DNA, 474 bp, Streptomyces sp.
atgactgcgcaggttcatgtcccgtctctcctcgcccgagccacgacggcctcggttctgactctcgccgccgtcggcggcaccctgttcgtccccggcgccatgaccgacgcccaggccgcgactcattcgatgaaggcgctcaacatcgccgcgtcgaagaagggttcgccgtaccggtggggcgccacgggccccagccgtttcgactgttcgggcctgacgctctattcgttcaagaaggcgggcaagaagctccctcgcacggcccagcagcagtacaacaagacccgtcacatctcggcctcgaagcggcagcgcggcgatctggtcttcttccactccggccgcagcatcttccacgtgggtatctacgcgggcagcggcaagatctggcactcgccgaagaccggtgccgtggtgcggctggagaggatctggacgaagagcgtctactacggccgggtcggctga

SEQ ID NO: 2418 - DNA, 480 bp, Streptomyces sp.
atgaccgcgcagaatcacgttccgtccgcagtctcccgaaccggtgccgtctcggccctggccctcgcggccctcaccggcacgctggtggcgccgggcgccgcccccgaggcgcaggccgcgggccccgcgtacgcgacgaaggccctcaacgtggcggcctccaagaagggctccccctacaagtacggggccgcaggcccctcccggttcgactgctcgggcctcacgctgtacgcgtacaagcaggccggaaagaccctcccgcgcaccgcgcagcagcagtacaaccgcacgcgccacatctcggcctccgccctccagaagggcgacctggtcttcttccactccggcggccgggtctaccacgtcggcgtctacgccgggagcaaccggatctggcacgccccgaaggcgggcaccgtggtgaggctggagcggatctggaccggcaaggtcctctacggccgcgtccgctga

SEQ ID NO: 2419 - DNA, 486 bp, Streptomyces sp.
atgactgcgctgcatcgtgctccgtcgcgtgttccgtcgctcctgacgagggccggtaccgcatcggctctcactctcgccgccgtgggcggcaccctcgtggcccccgggctcacgtcggaggcagaggccgcgacacacggaacgaaggcgctcaacatcgcggcttccaagaagggctcaccgtaccgctacggagccgccgggccgcaccggttcgactgctcgggtctcacgctctactcgttcaagcgcgtgggcaagaagctgccgcgcaccgccgcacagcagtacaacaagacccgccatgtgtccgccgccaaccgcacccgcggcgacctggtgttcttccactcgggccggaacgtgtaccacgtcggcatctacgccggtaagaacaagatctggcacgcgccgaagcggaacaccgtggtccggctagagaagatctggaccaggagcgtctggtacggccgggtccgctga

SEQ ID NO: 2420 - DNA, 474 bp, Streptomyces sp.
atgactgcgctcaatcgtgtcccgtcgctgatggtccgggccggtacggtctcggcgttcgccatggccgccgtgggcggctccgtcgtggttccgggtgtcgcagccgacgccgccgccgcgacgccggcgacgaaggcactcaaggtcgcggcctccaagaagggctcgccgtacaagtacggcgccacgggaccccgccgcttcgactgctcagggctgacgcagtactcgttcaagaaggtgggcaagaagctcccgcgcacggcggcccagcagtacaacaagacccgccacatcggagccggcagccgcaaggccggtgacctggtgttcttccactcgggctcgaacgtctaccacgtcggcatctacgccgggaagggaaagatctggcacgcccccaagaccggggacgtggtgcgactccagaagatctggacgaagagcgtctggtacggccgggtcaagtga

SEQ ID NO: 2421 - DNA, 474 bp, Streptomyces sp.
atgagtgcgctcaatcgtgtcccgtctctcatggcccgggccggcacggcctcggccctcaccctcgccgccgtgggcggctcgatcgtggtaccgggagcggccggggaggccgcggcggcgaccttgggcaccaaggccctgaaggtcgcggcgtccaagaagggggcgccgtacgcgtggggggcgaccggaccgaaccggttcgactgctcgggcctgacgctgtactcgttcaagaaggcggggaagaagctcccccgcacggccgcccagcagtacaacaagacgcgccacatctccaagagcagccgtaaggccggggacctggtgttcttccactcgggcagctacgtgtaccacgtcgggatctacgcgggtaagaacaagatctggcacgccccgaagactggggacgtggtgcggctccagaagatctggaccaacagcgtctggtacggccgcgtgaagtga

SEQ ID NO: 2422 - DNA, 444 bp, Streptomyces sp.
atggtccgggccggtacggcctcggccctcaccatcgccgccgtgggcggcacgatcgtggctcccggcttctcctccgaggcagcggcagccacaccggcgaccaaggcactccagatagcggcctcgaagaagggatcgccctacaagtacggggccaccggcccgcacaggttcgactgctccggcctcacgctgtactcgttcaagaaagcgggcaagaaactcccccgcacggccgcccagcagtacaacaagacgcgccacatctccgccaagaaccgcaaggcgggagacctggtgttcttccactcgggcagcagcgtgtaccacgtcggtatctacgcgggtaaaaacaagctctggcacgctcccaagagcggggacgtggtgcggctgcagaagatctggaccaagagcgtctggtacgggcgcgtgaagtga

SEQ ID NO: 2423 - DNA, 318 bp, Streptomyces sp.
ctggccctcgcgctggcggccgccgcggcgttcaccctcggtggaccgctcaccaccgcctccgccatcgaccacgtcacctgtgaccccgacgccggcttcctgaagatctggtcgcacatgaacgggcgccagagcgtggactgctacgcgaaccgggggaagaccgacttcggcggctggtgggtcgaccagatctccaccgggaacaacgacgtgaagtactacgacgccaacggcgacgtcgtgaagatcgcccgctggaacaacgtcaagtacaacaacacgccgaaggtcaaggccatcgagatcctctag

SEQ ID NO: 2424 - DNA, 1197 bp, Curtobacterium sp.
atgaccaccactccgtcgaccgtcgctcgtgcgcgccgactcccacgcatcgccggcgccgtgatggcactggccctggcggccggggcagtcgtcgcgacggccgagccggcagcggcctctgccgtctgggtcggctcggtccccgccggcacgaagatcctgcccggcgaccaggtcacgtcgccgaacggccagttcaagctcatcatgcagggcgacggcaacctggtcgagtacggcatcggcaaccgcgtgctgtgggcgtcgaacaccgccggcaactccggggcgatcgccgtcgtgcgcaaggaccgcgccctcgacatcacccggaacggcaagcgcctggtgcgctggacgtcggcgggcaccgcgagctccacggcgttcaaggtccgcgccgacggcacgatggccctgctcgccggcaaggccgtcgtcgtgggctggaccgggttccaggaccgcgtcgcgtcgggcaacaggatcctcggcgggacggtcctgcgctccgacacctcgaacacgcggatcctcaacatgcgcaccgacggcaacctggtgcagaaggtcagcggacgggtcgtctggcagtcgcggaccggcggccacccgggcgcctgggccgagctgcagaccaagggcaacttcgtcatctggacccgtgacgcgtcgcgtaagaaggtcgctatctggagctcccgcaccagcaccgccgggtcgggcaacctgctcgtgcaggtcgacggcaacgtggtgctctacggggcgaaggacacccgtgtctggtcgagccgaccggtcaccggcctggcctggcccgtcaacggcacgaagatcaccgggcggtacggcgacgaccgcggcgccgggcacgtcccgcgctaccaccagggcaccgacgcccccgtgccggtcggcactcccgtgtacggctcggggacgggcaccgtgacgcggacggtcgcgaacgacggggcctacggcaactacatcgtcgtgacgtacggcatgacgacggtcctgacggcgcacctcagcaagatcgaggtgaagcaggggcagatcgtgaagctcggcaccgagatcgccaagtccggcaacaccgggcagtcgacggggccgcacgtgcacgtcgagacgcggcggaacggcgtgctcgtcgacccgctgaagaacatgcacttccgctga

SEQ ID NO: 2425 - DNA, 1023 bp, Pantoea sp.
atgaccaccactccgtcgaccgtcgcacgtgcgcgccgactcccacgcatcgccggcgccgtgacggcactggccctggcggcgggggcgctcgtggcgacagccgaaccggcagcggcctctgcggtctgggtcggctcagccccggccggcaccaagatcctgcccggcgaccaggtcacgtcgccgaacggccagttcaagctcatcatgcagggcgacggcaacctggtcgagtacggcatcggcaaccgtgtgctgtgggcgtcgaacaccgccggcaactccggcgcgatcgccgtggtcggcaagaaccgcgccctcgacatcacgaagaacggcaagcgtgtggcccgctgggcctcggccggcaccgtgaactcgaccgcactgaaggtgcgcgccgacggcacgatggcgctgctcgcaggcaagaccgtcgtcgtgagctggaacggctaccaggaccgcgtcccgtcggggaacaccatcctgggcggcaccgtgctgcgatccgacacctcgaacacgcgcatcctcaacatgcgcaccgacggcaacctggtgcagaaggtcagcggccgcgtcgtctggcagtcgcgcaccggcggacacccgggtgcctgggcggagctgcaggccaagggcaacttcgtcatctggacccgtgacgcgtcgcgcaagaaggtcgcgctctggagctcacgcaccagcaccgccggatccggcaacctgctcgtccaggtcgacggcaacgtcgtgctctacggcgcgaaggacacccgggtctggtcgagccgaccggtcaccggcctggcctggcccgtcaacggcacgaagatcaccggccggtacggcgacgaccgcggcgccgggcacgtcccgcgctaccaccagggcaccgacgccccggtgccggtcgggacggccgtgtacggctccgggacggggacggtcaccaagaccatcgcgaacgacgcggcctacggcaactacatcgtcgtcacgtacggcatgacggcg

SEQ ID NO: 2426 - DNA, 1284 bp, Bacillus sp.
gtggtaaaacaaggcgacactctttctgctatcgcttcacaatacagaacaaccgcaaatgacatcactgaaacgaatgaaataccgaatcccgacagccttgttgtcggacaaaccattgtcattccaatagctggccagttctatgatgtgaagcgaggtgataccctgacatctatcgcccggcagttcaatacaacggcagccgagctcgcaagggttaaccgcatccagttaaataccgtgcttcagattggtttccgtttatacatcccaccagctcctaaacgagacatcgaatcaaatgcttatttggagccccgaggaaatcaagtcagcgaaaatctccagcaggcggccagagaagcgtcgccctacttaacgtaccttggcgcattcagcttccaggcacagcggaacggaaccttagtcgcaccgcctttaacgaatttaaggagcattacagaaagtcaaaatacaacattgatgatgattataacgaacctagaaaaccaagcattcagcgatgaacttggccggatccttttgaacgacgaaactgtaaaaagacggcttctaaatgaaatagtcgagaatgccagaagatatggcttccgtgacattcatttcgactttgaatatttgcggccccaggatagagaggcctataatcaattcctccgcgaagcaagggatctttttcatcgagagggcttagaaatttctacggctcttgctcctaaaacaagtgcaacacagcagggcagatggtatgaagctcatgattacagggcgcatggccaaattgtcgactttgttgttctcatgacatatgaatggggctatagcggcgggccgcctcaagcggtttctccaattggacctgtccgtgatgtcatagaatatgctttgactgaaatgcctgcgaacaaaattgtcatgggccagaatttatatggatatgactggacgctgccatatacagcagggggaactccggcaagagctgtaagccctcagcaagcaattgtcatagctgatcagaacaatgcttccattcagtatgaccaaaccgctcaagctcctttcttccgctatactgatgcagaaaacagaaggcacgaggtatggttcgaggatgcccgctcgattcaagcaaaattcaatttgattaaagagctgaatttaagaggcatcagctattggaagctgggtctttcctttccacaaaactggctgctgctgtctgatcaatttaatgttgtcaaaaagacgtttcgataa

SEQ ID NO: 2427 - DNA, 1284 bp, Bacillus sp.
gtggtaaaacaaggcgacactctttctgctatcgcttcacaatacagaacaaccgtaagtgagatcactgaaacgaatgaaataccgaatcccgacagccttgttgtcggacaaaccattgtcattccaatagccggccagttctatgatgtgaagcgaggtgataccctgacatccatcgcccggcagttcaatacaacagcagccgagctcgcaagggttaaccgcatccagttaaataccgtgcttcagattggtttccgtttatacatccctccagctcctaaacgagacatcgaatcaaatgcttatttggagccccgaggaaatcaagtcagcgaaaatctccagcaggcggccagagaagcgtcgccctacttaacgtaccttggcgcattcagcttccaggcacagcggaacggaaccttagtcgcaccgcctttaacgaatttaagaagcattgcagagaatcaaaacacggcattgatgatgattataacgaacctagaaaaccaggcattcagcgatgaactcggccggatccttttgaacgacgatactgtaaaaagaagacttttaaatgaaatagtcgagaatgcaaaaagatatggtttctatgatattcattttgactttgaatatttgcggcctgaggatagagaagcctataaccaatttctccgcgaagcaagggatctttttcatcgagagggcttagaaatttctacggctcttgctcctaaaacaagtgcaacacagcagggcagatggtatgaagctcatgattacagggcacatggccaaattgtcgactttgttgttctcatgacatatgaatggggctatagcggcgggccgcctcaagcggtttctccaattggacctgtccgtgatgtcatagaatatgctttgactgaaatgcctgcgaacaaaattgtcatgggccagaatttatatggatatgactggacgctgccatatacagcagggggaactccggcaagagcaataagccctcaacaagccattgtcattgccgatcaaaacaatgcagaaattcagtatgaccaaaccgctcaggcccctttcttccgctatactgatgcagaaaacagaagacacgaggtatggttcgaggatgcccgctcgattcaagcaaaattcaatctgattaaagagctgaatttaagaggcatcagctattggaagctgggtctttcctttccgcaaaactggctgctgctgtctgatcaatttaatgttgtcaaaaagacgtttcgataa

SEQ ID NO: 2428 - DNA, 1284 bp, Bacillus sp.
gtggtaaaacaaggcgacactctttctgctatcgcttcacaatacagaacaaccgtaagtgagatcgctgaaacgaatgaaataccgaatcccgacagccttgttgtcggacaaaccattgtcattccaatagctggccagttctatgatgtgaagcgaggtgataccctgacatctatcgcccagcagttcaatacaacggcagccgagctcgcaagggttaaccgcatccagttaaataccgtgcttcagattggtttccgtttatacatcccaccagctcctaaacgagacatcgaatcaaatgcttatttggaaccccgcggaaatcaagtcagcgaaaatctccagcaggcggccagagaagcgtcgccctacttaacgtaccttggcgcattcagtttccaggcacagcgtgacggaacattagtcgcaccgcctttaacgaatttaagaagcattgcagagaatcaaaacacggcattgatgatgattataacgaacctagaaaaccaggcattcagcgatgaactcggccggatccttttgaacgacgatactgtaaaaagaagacttttaaatgaaatagtcgagaatgcaaaaagatatggtttctatgatattcattttgactttgaatatttgcggcctgaggatagagaagcctataaccaatttctccgcgaagcaagggatctttttcatcgagagggcttagaaatttctacggctcttgctcctaaaacaagtgcaacacagcagggcagatggtatgaagctcatgattacagggcacatggccaaattgtcgactttgttgttctcatgacatatgaatggggctatagcggcgggccgcctcaagcggtttctccaattggacctgtccgtgatgtcatagaatatgctttgactgaaatgcctgcgaacaaaattgtcatgggccagaatttatatggatatgactggacgctgccatatacagcagggggaactccagcaagagcaataagccctcaacaagccattgtcattgccgatcaaaacaatgcagaaattcagtatgaccaaaccgctcaggcccctttcttccgctatactgatgcagaaaacagaagacacgaggtatggttcgaggatgcccgctcgattcaagcaaaattcaatctgattaaagagctgaatttaaaaggcatcagctattggaagctgggtctttcctttccgcaaaactggctgctgctgtctgatcaatttaatgttgtcaaaaagacgtttcgataa

SEQ ID NO: 2429 - DNA, 1284 bp, Bacillus sp.
gtggtgaaacaaggcgacactctctctgctatcgcttcacaatacagaacaactgtaaatgaaatcacagaaacgaatgaaatacctaatcccgatagccttgttgtcggacaaaccattgtcattccaatagccggccagttctatgatgttcaacaaggtgataccctgacatccatcgcacggcggttcaatacaacagcagccgagcttgccagggttaaccgaatccagttaaataccgtactgcagattggtttccgcttatacatccctccggttcctaaacgagacatcgaatcaaatgcttatttggagcctcgcggaaatcaagtcagcgaaaatctccagcaggcggccagagaagcgtcgccctacttaacgtaccttggcgcattcagtttccaggcacagcgtgacggaaccttagtcgcgccgcctttaacgaatttaagaagcattgcagagaatcaaaacacgacattgatgatgattataacgaacctagaaaaccaggcattcagcgatgaacttggccgaatccttttgaacgacgatactgtaaaaagaagacttttaaatgaaatcgtcgagaatgccaaaagatatgatttctatgatattcattttgactttgaatatttgcggcctcaggatagagaagcctataatcaatttctacgtgaagcaagggatcttttccatcgagaaggcttagaaatttctacagcgcttgcccctaaaacaagcgcaacacagcagggcagatggtacgaagcccatgattacagagcacatggccaaattgtcgactttgttgttctcatgacatatgaatggggctatagcggcgggccacctcaagccgtttcgccaattgggcctgttcgggatgtcatagaatatgctttgactgaaatgcctgcgaataaaattgttatgggccagaatttatatgggtatgattggacgcttccgtatacagcagggggaaccccggcaagagcaataagccctcagcaagcccttgccattgccgatcaaaacaatgcaaccattcagtatgaccaaacagctcaagcgcctttctttcgctatactgatgcagaaaacagagggcacgaggtatggttcgaggatgctcgctcgatccaagcaaaattcaacctgattaaagagctgaatttaaggggtattagctattggaagttaggtctttcctttccccaaaactggctgttgctgtctgatcaatttaatattgtcaaaaagacgtttcgataa

SEQ ID NO: 2430 - DNA, 1284 bp, Salinibacillus sp.
gtggtgaaacaaggcgacactctttctgctatcgcttcacaatacagaacaactgtaagtgaaatcacagaaacgaatgaaataccgaatcccgacagccttgttgtcggacaaaccattgtcattccaatagctggccagttttatgatgttcaacaaggtgataccctgacatccatcgcacagcgatttaatacaacagcagctgagcttgccagggtgaaccgcatccagttaaataccgtactgcagattggtttccgtttatacattcctccagttccaaaaagagatattgaatcaagcgcttatttggagccacgcggaaatcaagtcagcgaaaatctccagcaggcggccagagaagcatcgccctacttaacgtaccttggggcattcagtttccaggcacagcgtgatggaaccttagtcgcaccgcctttaacgaatttaagaagcattgcagagaatcaaggcacgacactgatgatgattataacgaacctagaaaaccaggcattcagcgatgagctcggccggatccttttgaacgacgatactgtgaaaagaagacttttgaatgaaatagtcgagaacgccagaagatatggcttccgtgctattcattttgactttgaatacttacggccccaggatagagaggcatataatcaatttctccgcgaggcaagggatctttttcatcaagaaggcttagaaatttctacggcgcttgcccctaaaacaagcgcaacacagcagggcagatggtacgaagcccatgattacagagcacatggccaaattgtcgacttcgttgttctcatgacttatgaatggggctacagcggcggacctcctcaagctgtttctccaattggtcctgttcgggatgtcatcgaatatgctttgacagaaatgcctgcgaataaaattgtcatggggcagaatttatatgggtatgattggacgctgccatttacagctggcggacctccggcaagagcaataagccctcagcaagccattgtcatagccgatcaaaacaatgccgacatccagtatgaccaaaccgctcaagcccccttcttccgctatactgatgcagaaaacaaaaggcacgaggtatggtttgaagacgcccgttcgattcaggccaaattcaatctgattaaagagcttaatttaagagggatcagctactggaagctggggctttcctttcctcaaaactggctgctgctttctgatcaatttcaagttgtcaaaaagacgttccgttaa

SEQ ID NO: 2431 - DNA, 1281 bp, Bacillus sp.
gtgaaacaaggtgacactcttactgctatcgcttcacaatacagaacaactgtaaatgaaattacagagacgaatgaaataccgaatcccggcagccttgttgtcggacaaaccattgtcattccaatagctggccagttttatgatgttcaacaaggcgataccctgacatccatcgcacggcaattcaatacgacagcagccgagcttgccagggtgaaccgaatccagttaaataccgtactgcagattggtttccgtttatacattcctccagttcctaaacgagacatcgaatcaagtgcttatttggagccccgcggaaatcaagtcagcgaaaatctccagcaggcggccagagaagcgtcgccctacttaacgtaccttggcgcattcagtttccaggcacagcgtgatggaaccttagtcgcaccgcctttaacgaatttaagaagcattgcagagaatcaagacacgacaatgatgatgattataacaaacctagaaaaccaggcattcagcgatgagctcggccggatccttttgaacgacaatactgtgaaaagaagacttttgaatgaaatagtcgagaatgccagaagatatggcttccgtgctattcattttgactttgaatacttacggccccaggatagagaggcatataatcaatttctccgcgaggcaagggatcttttccatcgagaaggcttagaaatttctacggcgcttgcccctaaaacaagcgcaacacagcaggggagatggtacgaagctcatgattacagagcccatggccaaattgtcgactttgttgtcctcatgacatatgaatggggctatagcggcgggccagctcaagctgtttctccaattgggcctgttcgagacgtcatagaatatgctttgacagaaatgcctgcgaataaaattgtcatgggacagaatttatatgggtatgactggacactgccttatacagcaggaggaaatccggcaagagcgataagccctcagcaagccattgtcatagctgatcaaaacaatgccgacatccagtatgacgaaaccgctcaagcccctttctttcgctatactgatgcagaaaacagaaggcatgaggtatggtttgaggatgcccgatcgatccaagccaaattcaatctgattaaagagctgaatttaagaggcattagttattggaagctgggactttcctttcctcaaaactggctgctgctttctgatcaatttcaagttgtcaaaaagacgttccgttaa

SEQ ID NO: 2432 - DNA, 1284 bp, Bacillus sp.
gtggtgaaacagggtgacactctttctgctatcgcatcacaatacagaacaaccgtaagccagatcacagaagcgaatgaaataccaaataccgacagccttgttgtcggacaaaccattgtcattccaatagctggccagttctatgaggtgaagcaaggtgataccttggcatcgatcgcgcggcagtttcgtacaacggcagctgagctcgccagggttaaccgcattcagttaaataccatgcttcagattggtttccgtttatacattcctacggttcccaaacgtgatatcgaatcaaatgcttatttggagccccgaggaaatcaagtcagcgaaaatctgcagcaggcggccagagaagcgtcaccctatctaacatatcttggcgcattcagtttccaagcacagcgggacggaaccttagccgcaccgcctttaacgaatttaagaagcatcgcagagaatcaaaacacgtcattaatgatgattatcacgaatttagaaaaccaggcattcagcgatgagctaggtcaagtccttttgaacgacgttactgtaaaaagaagacttttaaatgaaatcgtcgagaatgcaaaaagatatggtttttatgatattcatttcgattttgaatatttgcggcccgaggatagagaagcctataatcaatttcttcgcgaagcaagggatcgtttccaccgagaaggcctagaaatatctacggcacttgcccctaaaacaagtgcaacacagcagggcagatggtacgcagctcatgattacagagcacacggccaaatcgtcgactttgttgttctcatgacatatgaatggggctatagcggcgggcctgctcaagccgtttctccaattgggcctgttcgggatgtcatagaatacgctttgactgaaatgcctgcaaataaaattgtcatgggccagaatttatacggatatgactggacgctgccatatacagcagggggacccccggctagagcaataagccctcagcaagccattgtcatagccgatcgaaacaatgcttccattcaatatgaccaaacggctcaagcccctttcttccgctatactgatgcagaaaacaggagacacgaagtatggtttgaagatgcccgctcaattcaagcaaaattcaatctgattaaagagctgaacttaagaggcatcagctactggaagctgggtctttccttcccgcaaaactggctgctgctgtctgatcaatttaatgttgtcaaaaagacgtttcgataa

SEQ ID NO: 2433 - DNA, 1134 bp, Bacillus sp.
gtgaagcgaggtgataccctgacatccatcgcccggcagttcaatacaacagcagccgagctcgcaagggttaaccgcatccagttaaataccgtgcttcagattggtttccgtttatacatccctccagctcctaaacgagacatcgaatcaaatgcttatttggagccccgaggaaatcaagtcagcgaaaatctccagcaggcggccagagaagcgtcgccctacttaacttaccttggcgcattcagcttccaggcacagcggaacggaaccttagtcgcaccgcctttaacgaatttaaggagcattacagaaagtcaaaatacaacattgatgatgattataacgaacctagaaaaccaggcattcagcgatgaacttggccggatccttttgaacgacgaaactgtaaaaagacggcttctaaatgaaatagtcgagaatgccagaagatatggcttccgtgacattcatttcgactttgaatatttgcggccccaggatagagaggcctataatcaattcctccgcgaagcaagggatcttttccatcgagagggcttagaaatttctacggctcttgctcctaaaacaagtgcaacacagcagggcaggtggtatgaagctcatgattacagggcacatggcgaaattgtcgactttgttgttctcatgacatatgaatggggctatagcggcggaccgcctcaagcggtttctccaattggacctgtccgtgatgtcatagaatatgctttgactgaaatgcctgcgaacaaaattgtcatgggccagaatttatatggatatgactggacgctgccatatacagcagggggaactccagcaagagcagtaagccctcagcaagccattgtcatagctgatcagaacaatgcttccattcagtatgaccaaaccgctcaagctcctttcttccgctatactgatgcagaaaacagaaggcacgaggtatggttcgaggatgcccgctcgattcaagcaaaattcaatctgattaaagagctgaatttaagaggcatcagctattggaagctgggtctttcctttccacaaaactggctgctgctgtctgatcaatttaatgttgtcaaaaagacgtttcgataa

SEQ ID NO: 2434 - DNA, 1134 bp, Bacillus sp.
gtgaagcgaggtgataccctgacatccatcgcccggcagttcaatacaacagcagccgagctcgcaagggttaaccgcatccagttaaataccgtgcttcagattggtttccgtttatacatcccaccagctcctaaacgagacatcgaatcaaatgcttatttggagccccgaggaaatcaagtcagcgaaaatctccagcaggcggccagagaagcgtcaccctacttaacgtaccttggcgcattcagcttccaggcacagcgtaacggaaccttagtcgcaccgcctttaacgaatttaaggagcattacagagaatcaaaacacggcattgatgatgattataacgaacctagaaaaccaggcattcagcgatgaactcggccggatccttttgaacgacgatactgtaaaaagaagacttttaaatgaaatagtcgagaatgcaaaaagatatggtttctatgatattcattttgactttgaatatttgcggcctgaggatagagaagcctataaccaatttctccgcgaagcaagggatcttttccatcgagaaggcttagaaatttctacggcgcttgccccaaaaacaagcgcaacacagcagggcagatggtacgaagcccatgattacagagcccatggccaaatcgtcgactttgttgttctcatgacatatgaatggggctatagcggcgggccggctcaagctgtttctccaatcgggcctgttcgggatgtcatagaatatgctttgactgaaatgcctgcgaataaaattgtcatgggccagaatttatatgggtatgactggacactgccatacacagctggcggaactccggcaagagcaataagccctcaacaagccattgtcattgccgatcaaaacaatgcagaaattcagtatgaccaaaccgctcaggcccctttcttccgctatactgatgcagaaaacagaagacacgaggtatggttcgaggatgcccgctcgattcaagcaaaattcaatctgattaaagagctgaatttaagaggcatcagctattggaagctgggtctttcctttccgcaaaactggctgctgctgtctgatcaatttaatgttgtcaaaaagacgtttcgataa

SEQ ID NO: 2435 - DNA, 1281 bp, Bacillus sp.
gtgaaacaaggtgacactctttctgctatcgcatcgcaataccggaccacagtaaatgaaataacagaaacgaacgagataccgaatccagataaactcgttgtcggacaaaccattgtaattccgattgcaggacagttttatgatgttaaacaaggcgataccctcacgtccatcgcccgtcagttcaatacaacagctgccgagcttgccaggattaatcgcattcagttaaacgctgttttacaaattggctttcgtctatatattcctccgctacccaaaagcgatatagaatcaaatgcatatgtggagccacgcggaactcaggttagcgagaatcttcagcaggcggtgagagaagctgttccctacctgacttatctgggtgcgttcagctttcaagtacagcgggacggcactttagaagagcccccgatgacaaacctaaaagccatcagcgacagccaaaatacaacgttaatgatgattgtcactaacttagaaaatgaagcatttagtgatgaacttggacggattattttaaatgacgataccgtaaaaaccaaactgttaactgaaattgttgcgactgctagaaaatatggatttcgggatattcattttgactttgaatacttacgtcctgaagataaagaagcctataatcagtttctgcgtgaagcaagagatattttacacagggagggctggctgatctctacggcacttgccccgaaaaccagtgcaactcaaaaaggcaaatggtatgaagctcatgattataaggctcacggagagattgtggactttgttgtgattatgacatatgaatgggggtatagcggcggtccggctcaagccgtttctcctataggacccgtccgggatgtcattgaatatgctttaactgaaatgcctgcaaacaaaatcgttatgggacagaatttatacggatatgattggaccttgccgtacaccgctggcggagacctagcgaaagctctcagtccgcagcaggcgattgtactggccggccaaaataatgcagcaatccaatacgatgaaacatctcaggctcccttctttcgctataccgattcaaacaacaaacagcatgaggtatggttcgaagacgcacgttccattcaagcaaaattcaatttaattaaggaactgaatttaagagggatcagctattggaaactcgggctctctttccctcaaaactggctgttaatcgctgatcaatttaatattgtcaaaaagacgtttcgttaa

SEQ ID NO: 2436 - DNA, 1284 bp, Bacillus sp.
gtgcaaagaggcgataccctatatagaattgcgaaccggtacaggacgacggtcaatgaaattgtcgaaacaaatgaaattcccaatccaaatcggcttgtggtcggacaaaccatcgtcatcccgattgccggccaattttatgaagtcagacaaggagatacactggcatcgattgcggcgcgctttaatatcccccctgctgaactggccagaatcaaccgcattctgatcaccgccgttttgcctgtcggaatactgctgtacatccctccgcggccaaagcggaacatcgaatcaaacgcttatatagaaccccgcggagaaacggtcagccccgctcttcagcaggcggcaagagaggcggtgccatacctgacatatctcggcgctttcagctttcaggcaaaacgggacggcacacttgaagaaccgccgctcaacggtttaaaagaaattgccgacagacagcggacgaccatgatgatgattgtgaccaatcttgaaaatgaagcattcagcgctgagctcggcaggatcatcttgagggacgagaatgtcaaaaacagattgctgaataacattgtggccgccgccaggagatacggtttcaaagacattcattttgactttgaatacttaaggccggaggatagagaagcatataatcaatttcttcgggaagcccgggatcgtttcagacgggaaggttggttgatctcaaccgccctcgcgccgaaaacaagagccgatcagccgggacaatggtatgaagcccacgactaccgggcgcacggtcaaattgtcgattttgtcgtgctgatgacatatgaatgggggtacagcggaggtccgccaatggcggtgtcgccgatcgggcctgtacgggatgttatcgagtacgcgctcacagaaatgcccgccaataaaattgtcatgggacaaaacctgtacggctatgattggactcttccgtatactcccggaggggaattggccagagccatcagtccgcagcaggcgatacaaatcgcaagcgaaaataatgcggccatatcgtttgacgaaacagcccaggcaccctttttccgctatacagacaaagcgggcaagcggcatgaagtctggtttgaagatgcgagatccatccaggcgaaattcgatttgatcaaagaattaaacttaagaggaatcagctattggaagctcggcctgtcattcccgcagaactggcttttgcttggtgatcaatttaacattgtgaaaaggacgttcccaagttaa

SEQ ID NO: 2437 - DNA, 1281 bp, Bacillus sp.
gtgaaacggggcgacacactttccgctattgcggcgcgctaccggacagccgcaaatgtcattgcggaagcaaataaactgcctaatccaaatacattggttgtcggacaaacccttgtcatcccgattgagggtcaatattacgaagtgaaacaaggtgatactctcgcggcaatcgccggccgttttcatatatcggccgcggagcttgcgagggtgaacggaattcagcccggcaccacattgagagtcggaacccgcctttacattccgcagcaggcgaataagcccgatatcgaatcaaatgcatatatagaaccgcggggaacgagcgtaagcgctaatctgcagcaggcggcaagggaggcctctccttatttaacatacctcggcgcattcagttttcaagtgcagcggaacgggactttaaaggaaccgcccctgaccaatttaaaaagcatcagtgacaggcacaacaccacactgatgatgatcatcaccaaccttgaaaatgacgcattcagcgatgaactcgggcggctcatcttgaatgacaatacagtgaaaacaaaactcttccaggaaatcgtctccacggctaaaaagtacggctttcgtgatattcactttgatttcgaatatttacgtccacaggacagagaagcctacaatcgttttttacgtgaagcgaggacgatttttcatcgggaaggctggaagatttcaacggcgcttgctccgaaaacgagcgcgactcaggccggcaaatggtacgaagcacatgactatagggcacatggagaaatcgtcgattttgtcgtaatcatgacatatgagtggggatacagcggaggcccggctcaggccgtatcacctatcggccctgtaagaaatgtcattgagtacgcgctgacggaaatgccttcttcaaaaatcgtcatgggccagaacatgtacggctacgattggacactgccttttaaacagggaacgacagccaaagccgtcagtcctcagcaggcaatcgctctggcagcacgccataaagtcgacattcaatatgacgaaaccgcccaggctccattctttcgttacacggatgaaaatcagagacggcatgaagtatggtttgaagacgcacgatccattcaagcgaaattcaatttaattaaagaacttcatttaagaggaatcagctattggaaactcggcctctccttcccgcaaaactggcttttgctcggtgatcaatttcatattgtgaaagagacgtttcgttaa

SEQ ID NO: 2438 - DNA, 1281 bp, Bacillus sp.
gtgaaacggggcgacacactttctgctattgcggcgcgctaccggattgccgcaaatgtcattgcggaagcaaataaactgcctgatcccaatacattggttgtcggacaaacccttgtcattccgatcgagggacaatattacgaggtgagacaaggcgatactcttgcggcaatcgccggccgttttcatatatcggccgcggagcttgcgagggtgaacggaattcagatcggcaccacattgcaagtcgggacccgcctgtacattccgcagcagacgaataagcctgatatcgaatcaaatgcatatatagaaccgcggggaacgagcgtaagcgctaacctgcagcaggcagcaagagaggcctcaccttatttaacatacctcggcgcattcagttttcaggtgcagcggaacgggactttaaaagaaccgcccctgaccaatttaaaaagcatcgccgacaggcacaacaccacattgatgatgatcatcaccaaccttgaaaatgacgcattcagcgatgaactcgggcggctcatcttaaatgataatacagtgaaaacaaagctctttcaggaaatcgtctccacggcaaaaaagtacggcttccgcgatattcattttgatttcgaatatttgcgtcctcaggacagagaagcctacaatcgttttttacgtgaagcgagaacgatttttcatcgggaaggctggaagatttcaacggcgcttgctccgaaaacgagtgcgacccaggccggcaaatggtatgaagcacatgactatagggcacatggagaaatcgtcgattttgtcgtgatcatgacatatgagtgggggtacagcggaggcccggctcaggccgtatcaccaatcggccctgtaaggaatgtcattgagtacgcgctgacagaaatgccatcttccaaaatcgtcatgggacagaacatgtacggctacgattggacactgccttttaaacagggaacgacagcgaaagccgtcagtcctcagcaggcgatcgctctggccgcacgctataaagtcgacattcaatataacgaaaccgctcaggctcccttctttcgatacacggctgaaaatcagaagcagcatgaagtatggtttgaagacgcccgctccattcaggcgaaattcaatttaattaaagaacttcatttaagaggaatcagctattggaaactcggcctctccttcccgcaaaactggcttttgctcggagatcaattccatatagtgaaagagacgtttcgttaa

SEQ ID NO: 2439 - DNA, 1299 bp, Bacillus sp.
attcagatttatgtcgtgaaaagaggcgataccctttaccaaatcgcgaatcgttaccgaacaacagttaatgaaattgtcgagacgaatgaaattccgaacccgaatcggcttgttgtcggacaaaccatcgtgataccgatcgccggcgagttttatgaggtcagacaaggagatacattagcatcaatcggagcacgctttaatatttctccggctgaactggcgaggatcaaccgcattcaggttagcgccgttttgcctgtcggactgctgctttatatcccccctcggccaaaacggaacattgaaacaaacgcttatattgaacctcggggagaaagcgtcagccccgctctgcagcaggcggcaagagaggcttcgccatacttgacttatctgggcgctttcagcttccaggcgaagcgggacggcacactcgaagaaccgccgctgaacaacttaaaagaaattgccgacagacatcggactacgatgatgatgattgtcaccaatctcgaaaatgaagctttcagcgacgaactcggcaggatcattctgacggaccagaatgtaaaaaacagattgctcgataacatcgttgcagcggccagaagatacgggtttaaagacatccattttgattttgaatacttaaggcctgaagatagagaagcctataatcagtttttacgggatgcccgggcccgcttcaaacaggaaggctggttcatctcaaccgcgcttgcgccgaaaacgagagcggatcagcctggacaatggtatgaggcccatgattaccgggctcacggcgaaattgtcgatttcgtcgtgctgatgacatatgagtggggctacagcggagggccgccgatggcggtatcgccgatcggacccgtccgggacgtgatcgaatacgcacttacggaaatgcccgccagcaaaatcgtcatgggacagaacttgtacggttatgactggacgctgccctatacgccaggcggacagctggccaaagcaatcagccctcagcgagcaattgagatcgcgagtgagaacaacgcggcgatactgtacgatgaaacagctcaggctccttacttccgctatacggacaatgccggcaaacagcatgaggtatggtttgaagatgcccgctcgattcaagcaaagtttgatctgattagggaattgaatttaaggggcatcagctattggaagctcggcctgtccttcccgcaaaactggctcttgatagccgatcaatttaatgttgtgaaagagacgttcccaagttaa

SEQ ID NO: 2440 - DNA, 1320 bp, Bacillus sp.
atgagaaaggaggcgtttcccattcagatttatgtcgtgaaaagaggcgataccctttaccaaatcgcgaatcgttaccgaacaacagttaatgaaattgtcgcgacgaatgaaattccgaacccgaatcggcttgttgtcggacaaaccatcgtgatcccgatcgccggcgagttttatgaggtcagacagggagatacattagcatcaatcggagcacgctttaatatttctccggctgaactggcgaggatcaaccgcattcaggttagcgccgttttaccggtcggactgctgctttacatcccccctcggccaagacggaacattgaaacaaacgcctatatcgaacctcggggagaaagcgtaagccccgctttgcagcaggcggcaagagaggcttcgccatacttgacctatctgggcgctttcagcttccaggcgaagcgggacggcacactcgaagaaccgccgctgaacaacttaaaagaaattgccgacagacatcggactacgatgatgatgattgtcaccaatctcgaaaatgaagctttcagcgacgaactcggcaggatcattctgacggaccagaatgtaaaaaacagattgctcgataacatcgttgcagcggccagaagatacggttttaaagacatccattttgacttcgaatacttaaggcccgaagatagagaagcctataatcagtttttacgggatgcccgggcccgcttcaggcaggaaggctggctcatctcaaccgcgcttgctccgaaaacgagagcggatcagcccggacaatggtatgaagcccatgattaccgggcccacggcgaaattgtcgatttcgtcgtgctgatgacatatgagtggggctacagcggagggcccccgatggcggtatcgccgatcgggcccgtccgggacgtgatcgaatacgcactcacggaaatgcccgccagcaaaatcgtcatgggacagaacttgtacggctatgactggacgctcccctatacgccaggcggaccgctggccagagcaatcagcccccagcgggcgattgagatcgcgagcgagaacaatgcggcgatacagtacgatgaaacagctcaggctccaaacttccgctatacggacaatgccggcaaacagcatgaagtatggtttgaagacgcccgctcgattcaggcaaagtttgatctgattagggaattgaatttaaggggaatcagctattggaagctcggcctgtccttcccgcaaaactggctcttgatagccgatcaatttaatgttgtgaaagagacgttcccaagttaa

SEQ ID NO: 2441 - DNA, 1320 bp, Bacillus sp.
atgagaaaggaggcgtttcccattcagatttatgtcgtgaaaagaggcgataccctttaccaaatcgcgaatcgttaccgaacaacagttaatgaaattgtcgcgacgaatgaaattccgaacccgaatcggcttgttgtcggacaaaccatcgtgatcccgatcgccggcgagttttatgaggtcagacagggagatacattagcaacaatcggagcacgctttaatatttctccggctgaactggcgaggatcaaccgcattcaggttagcgccgttttaccggtcggactgctgctttacatccctcctcggccaagacggaacattgaaacaaacgcctatatcgaacctcggggagaaagcgtaagccccgctttgcagcaggcggcaagagaggcttcgccatacttgacctatttgggcgctttcagcttccaggcgaagcgggacggcacactcgaagaaccgccgctgaacaacttaaaagaaattgccgacagacatcggactacgatgatgatgattgtcaccaatctcgaaaatgaagctttcagcgacgaactcggcaggatcattctgacggaccagaatgtaaaaaacagattgctcgataacatcgttgcagcggccagaagatacgggtttaaagacatccattttgacttcgaatacttaaggcccgaagatagagaagcctataatcagtttttacgggatgcccgggcccgcttcaggcaggaaggctggctcatctcaaccgcgcttgctccgaaaacgagagcggatcagcccggacaatggtatgaagcccatgattaccgggcccacggcgaaattgtcgatttcgtcgtgctgatgacatatgagtggggctacagcggagggcccccgatggcggtatcgccgatcgggcccgtccgggacgtgatcgaatacgcactcacggaaatgcccgccagcaaaatcgtcatgggacagaacttgtacggctatgactggacgctcccctatacgccaggcggaccgctggccagagcaatcagcccccagcgggcgattgagatcgcgagcgagaacaatgcggcgatacagtacgatgaaacagctcaggctccaaacttccgctatacggacaatgccggcaaacagcatgaagtatggtttgaagacgcccgctcgattcaggcaaagtttgatctgattagggaattgaatttaaggggaatcagctattggaagctcggcctgtccttcccgcaaaactggctcttgatagccgatcaatttaatgttgtgaaagagacgttcccaagttaa

SEQ ID NO: 2442 - DNA, 1302 bp, Bacillus sp.
ttgactattcaaatttatgttgtcaaaagaggagatactttaaacgaaattgccatgcgctttaaaacaacagtcaatgaaatcatccgtaccaacgatattgaaacaccaaatcaactcgtcattggacaaacaattgtcattccaattagaggacaattttatgaggtcaaacaaaatgacacactttatcaaattggaagacgatttcgaatttcagtggaggagttggcacgtgtgaatagaattcggcctgaagcgatactacctattcgcttcttgctctatattcctcaaagaccgaaaaggaacattaattcgaatgcttacattgaaccaaggggaaatcaagtcagtgaaaacttaaaacaagcagctagagaggcctctccatatttaacccatttaggcgcctttagtttccaagcgcaaagagacggaacactgaaagaaccaccgttagatcagctacctcaaatagccgctcagagcagaaccgttttatccatggtagtgacaaacctagagaatgaaaaattcagtgatgaacttgggcgaattcttttaaataaccaatctgtcaaaaccacatttttaaatgaaatcgttcgtgttgctaaaaagtatcaattaaaagaaatccattttgattttgaatatttacgtcctgctgataaagatgcttacattcaatttttaagagaggcaacaacccgcttccatcaagaaggatggacaatttctgttgcacttgcccctaaaacaagcagtcagcaaaagggaaaatggtatgaagctcatgactatgaagccattgggaagatcgtcgatcatgttgtgttaatgacctatgaatggggatacagcggcggccctgcgcaagctgtctctcccattggacctgtccgccaagtcattgaatatgcactgaccgtcatgccggccaataaaattgttatggggcagaatttatatggctatgattggacgcttccttacgtccagggcggccccattgctaaagccgtcagtcctcaacaagcgattgccattgctagaaataataatgcctccattctatacgacgaaacagcacaagcaccttattttcgttacacagatgccactaataaagagcatgaggtatggttcgaagacgctagatcgattcaagcaaagttcaatctcatcaaagagttaaacttgaacggaattgcttattggaaattaggtctatccttcccacaaaattggctcttattatcagatcaatttaatattgaaaaaagaacgacatcgtaa

SEQ ID NO: 2443 - DNA, 1302 bp, Bacillus sp.
ttgactattcaaatttatgttgtcaaaagaggagatactttaaacgacattgctatgcgttttaaaacgacagtcaatgaaatcatccgtactaacgaaatcgaaacaccaaatcaactcgtcattggacaaacaattgtcattccaattagaggtcaattttatgaggtcaaacaaaatgacacactatatcaaattggtagacggtttcaaatctcagtggaagaattggcacgcgtgaacagaattcggcctgaagcgatactgcctattcgtttcttgctctatattccacaaagaccgaaaaggaacattaattccaatgcttatattgaaccacggggaaatcaagtcagtgaaaacttaaagcaggcagctagagaggcctccccatacttaacccatttagacgtctttagttttcaagcacaaagagatgggacactgcgagaaccaccgttagaccaactaccccagattgccgctcagaacagaactgtattaaccatggtggtgacaaatctagagaatgaaaaattcagtgatgaacttgggcgtattcttttaactaaccaatctgtcaaaacggcatttttaaatgaaattgttcgtgttgccaaaaagtatcaattcaaggaaattcattttgattttgaatatttacgccctgctgataaagatgcttatattcaatttttaagagaagcaacagcccgtttccatcaagaaggatggacaatatctgttgcacttgcaccaaaaacaagtagtcagcaaaagggcaaatggtatgaagcccatgactatgaagcgatcggtaagatcgtcgaccacgttgtgttgatgacctatgaatgggggtacagcggcggccctccacaagctgtctctccaattggacctgtccgccaagtcattgaatacgcactaactgtcatacctgccaataaaattgtaatggggcagaatttatacggctatgattggacacttcctttcgtccagggcggccccatagccaaagccgtcagtcctcaacaagcaattgcacttgctagagagcacaatgtctctatcttatacgacgaaacagcacaagcaccccattttcgttatacagatgccaacaacaaagagcatgaggtctggttcgaagacgctagatcaattcaagcaaagttcaacctcatcaaagagctaaatttgaacggcattgcttattggaaattaggtctatctttcccacaaaattggctcttattatcagatcaatttaatattgaaaaaagaacgacatcgtaa

SEQ ID NO: 2444 - protein, 125 aa, Streptomyces sp.
MTKPSIRRCFGVAAATMAALAATVVPASAASSDVSILINRTNCNQNDYFEIHNNNGRDTLCFANAGSMPVAIYGVNWIESGNNVVTFEFQRNLSEPRLETVTLDKWRSWQPGQPSIHRVTWIRIH

SEQ ID NO: 2445 - protein, 326 aa, unknown
  environmental sample
MSNQGAFIALNQTLSTNDYLVSNNNAFFAIMQGDGNLCVYRGSAPDANQGFLWGALGQSQPNGNYFSIMQGDGNLCVYKGTGPSDNQGFVWGALNQSQPDRAYFAVLQDDGNLCVYKGTSPSDNQGGVWCSTAIDPVVDIEISSINYDVAAAKIIKSTPADLYRQSVTNNTAQSQTSSISGSESVSETSGWSDSLAVKVGVSTTFKTGIPFLAEGKISVSLDVTNTYTWNGSTTRTKTWSFNTPVTVPANSTYVALIAATVSTISVPYTLAGTLILKSGARVPGIVRGMYTGSNSHDLTVTYIKQDATTLNIESITQPVEYAKLVA

SEQ ID NO: 2446 - protein, 1095 aa, unknown
  environmental sample
MKFFKLKKVVIFFLVGSFLCPVTGYGQEMQEVAPSVSTSDSEVGTSESRSDVSGEMTETTTNASSEQASQGEETMMNSELVSASTDMSLFFDKKIRLRSVRSESAYLTWDGNGQFLMDALQSTMNQSFLINGTVEDGYTIQNSETSANLHVLSKEAFAQREEKIEQKWFFELLENGSYTVQTADGLYLSSNDKNELILSADAEDEAARWQVEVIEEPQKLPMEAPLTKIPLSEISIANGTYQIQSSGLSMFLSIGELDKTLRKQLVVSSEGYSLSSKFQITRQTDGWYTIKNKYSLLAADIAGGIGKPQVAVQQYQDNQSAAQRFRFLDAGNGDVVIESKLGTVIERTGGQSNESTPVQTYTFNNSAAQKWRVVSETVANEVNIADGIYNIAGSGINKNLSLANKSKSDRIGIVLDRNVSDQVQQQFDIKKEADGWYTITNNFSKKVLDISGGSAGSRVAVQQYFANKSDSQKFKFIDGGAGNVFILSKLGTVLDRTGGKTDNGTAIQTYRLNKTISQLWRLSAPQSPKTVDIKDGEYQIKGNSTTRVFSIGDLTTADAVLLRLRDSTYSKIDNFVINKQVDGWYQIKNKFSNKVLDIQSGSSKNGVQVQQYFANNSEAQKFRFIDAGNGEVYIQSMLGSVLERPGGGTSEGLAIKTNDLTNSAAQKWKIEKQASPNLVKPVNGQRYLLEAGNNTNAVLDINGGSTANGAVAHIWTEAVAPQQKFIPRDLGNGWYRLENEKSKKVLDVAGGSSSAKVAVQQYAWNGSDAQQFRFVDAGGGYVYVQSKLGSYLDMVGGASSNGTRIQTYSLNKSAAQKFKLQNISKANALRTTVTTNNQAKITVYNPNGGKVDSVRFPTWSREKGQDDIKWLIGKKNIDGSWTAEVNAAEFKNGGTFDTHVYVKSGGKESGVGTTSYKLDKPAPPAPPKPTAPPYYYSQWDGRWSGLTYGYYRFGPTGCVPTSMAMVLRGSYGVNVTPVDTANRIRSYGGFNVQYMGASSTDLVRGMNSYGRSVYAAKSEADLTDHLVQGYPVIMYVNVGIGHAIVAHGYSNGKTYISDPYNNQFYSGWVSISHLWSVPTKDPQDWNYGYPYFIIK

SEQ ID NO: 2447 - protein, 285 aa, unknown
  environmental sample
MGLQFLDKRYIAAIIIDAWQSNLNTEMDPADGQWFTNGPDNNGGLYGYLVDKIATKLVFDQSQKVFEVHQKAAVTGIADNRNGLTPNMTVSLKYAYQNSSTTSHTKSHSIKVGTGVDIKSKAEFLGCGGEVTFKFSFEYSHSWSDTTSTSKTETLEFSDTVPISIPVGHVMKVLLMCNEQQLEVPYFADIHLSGNSTTNFRSPVNGKKIWSTDAGTLCQWISQYKSSSDDNLIFCRDPDDPTKGLIRVKGMLTATQTVNFHVATEDITKSFDGYIPEGIAQAVAV

SEQ ID NO: 2448 - protein, 476 aa, Actinosporangium sp.
MIESRTPRWRRRLSLLLAAVAGPALLAGVFTATPAHAATADDIRLNEVVTTGSTNDSIELHNKGAGTVDLSGWILKDSNSSSKYTIGSGTTLAPGGFRAFDVHDAFGLGSSDKARLYLADGSTLVDSFSWSSHSSASWSRCPDGSGSFGQAATLTLGAANNCGGGGGGGVTPSAWPGSSTVTTADASNVFGSDLSGLHQEGGVLWAAQNSGKLWRLVSNGSGGWQPDTASGWSAGKTLRFTGGSGAPDSEGVTVTGAGSGSAGGVFVASERNGDASGTSRLSVLRYDVTGTNSTLSATREWNLTSNLPSVGSNAGFEAITWIPDSALTSAGFKDESTGAAYDPSRYTAHTGGVFFVGVEGTGSLYGYVLTDTGAYTRVASLSSGMAGVMELQWEPQTSRLWLVCDDNCSGQHRTMKIDTTGAFATTAAYNRPGGMSNLNNEGFALAGECVAGAKSVVWSDDGNTGGHALRAGTIGC

SEQ ID NO: 2449 - protein, 116 aa, Actinosynnema sp.
MRSSSKKFTLAAATAVAALVAIPAGPAFAIDQVACGNRTDFAKLDIRVGQNLGTNRCFANSGVVAVEVPNVYRASSGNNKLTVNYQSGSQYYTRTLTPGTHINFASVVRVYEVRIW

SEQ ID NO: 2450 - protein, 766 aa, Ammonifex sp.
MIKARKRWLSVLLTVAMLAALLVPLAQPAQAACTYSMTYIQKVKAGGTYDIGTLVVTVDPVSAEASVGRYVVLSLPGSPSGYELFPGLSENEIAAKITGTNYFNTANGATFKVERLSAREVRLWVGSIATAGIAPGDDSRILIPLRITVPSGVSGDIILTVSAPSTSAFLNGSLVIARADANLPDWVFAVYMAADNDLSRFALADLREMLSVPGLGGNVVVVLLDLPGSENDGVYLVQRGTLQPVPGWPQGQELNTGDPSLLAAFLDFVRNKFPAGRYALILWDHGAGWRKLQPRGVCFDDLSRDFLMVPELRQALVRARVPLDLVGFDACFMGMVEVAYELEGLASVMVASEEGEPGDGWPYDKILTWLVANASTADGKALGRAIVSAYTQAYQGYGALTMSAIDLGCIKDVREKTDSLAVALLRNFDSDKTQISQAVQNARSYHREEFRDLYDYASLLTSYCSSSVEIRAAAQDLQKSIERAVLANGTTQYDDRSRGLSIWLPPESQAYLELLSYYGVDFASMFNWYSNLRFAKESRWGHFIKKWILDESTPIATAFGVESTDPADGATDVPVDKTITLTYNTPVRPGPAYGKIALLDASGRKVSIRKKLAGTVFTIDPVKNLSYGTTYTLVLPAGAVKDGAGNLSEEFVLSFTTEPPDVTPPAVVETDPPAGGVVDSLKPVLKVRFSEQVYTGRNYSRIAIYDESGRRVAVSKRISGDLLEVRPVGALKPGMAYRLYLPAGAVKDKAGNLSEEFELVFVAPGP

SEQ ID NO: 2451 - protein, 116 aa, Amycolatopsis sp.
MRKSLKRLSVVGAAALGLLVAVPASPAFAIGEVACGNRDDFVKLDISFGNGMGTNKCFANAGVTGTNIGGVYNVFSGNNKVTVNYERNGRYETSTLGYWQGVGFSGTVRVYEVRIW

SEQ ID NO: 2452 - protein, 117 aa, Amycolatopsis sp.
MISSKKSAGRIAAMAAAAAAMFSMVVPTGTSFAIDHIPCRAGENFLKIWSHLDGRDSVDCYANRGRIGFGGWWVDKIETGNNDLIYSDANGDSVRVNRWTIITYPNRPPRVNYIEIL

SEQ ID NO: 2453 - protein, 117 aa, Amycolatopsis sp.
MISTKKKARRVLAAAAAAAAAFSLLVPTGTSFAIDHIPCRDGENFLKIWSHLGGSSSVDCYANKGRISFGGWWIDRIYTGNNDLIYYDSNGSDVRINRWTDISFPNRPPKVRVIEIL

SEQ ID NO: 2454 - protein, 184 aa, Arthrobacter sp.
MKKLSIWLAAILMAVGLGILVPGPASATTSYCGLVWGSLAETDQRFSKTTVTNVRTGQHYCFDRMVLDLKGPATGYNVRYVPRVVQDGSGFTVPVRGGARLQVTLHAPSYDPYSGEPTYNPPANQAELSNVANYQTFRQVAWAGSYEGYTNIGLGVRARLPFRVFTLDGPGSNSRLVIDVAHFW

SEQ ID NO: 2455 - protein, 260 aa, Arthrobacter sp.
MRSARPLIFFLSVTASASFCLSGCMVNASAENRETGTAPATQPPSASAPPANPSAKPTTTETLPPPTTAPAEPLPSAVPPSSSDPAPAADPVTFTFADGRLSFTHPAGWRVEHSQTVASPSVQNATVYDTSGNEQIGIFYSEVGGGVAGPHTRTVFFSEPVPGLQGHSGPASGPATAHVSFYVDHIYGEPHYSLSLTHREALSPDGTEGADVVIVGGNRVLAANVVFTGGPFASDEAAKAWFAGTEGQALKAILMSFSYR

SEQ ID NO: 2456 - protein, 181 aa, Arthrobacter sp.
MKKLLLWLTVLLAAVGLGILAPGPASAATSYCGLAWGSQDKTAPEMSSASVTNVRTGQQPCFDRMVVDLNGPVKGYTVRYVPEIIQDGTGFTIPVYGNARLQVVVNAPSYDSNGVTYNPAAKAELSNVAGYQTFRQVVYANSFEGSTSIGLGVRARLPFRVFTLDGPGSGSRLIVDVAHFW

SEQ ID NO: 2457 - protein, 1031 aa, Arthrobacter sp.
MEQSTARNLSQRLLRGRKLTTIVAAAALAVAGMTAVVSSTPAYADQQRQVVGTGLTKPAGTVVDPVGKVWVSDSVAGFCRMSDPVNGQPGTVEKDTCLGGSLAGSQQGPKVPGVATILDPTPSSAGSGDETAFIPDSSVGSSHVVRAVWSPALDLFEYSSTLTILDGDVRPNAVSDGPDGNIYLSFANARSIIKIVDPTIKHPSIESIASVTTKALGLVAAGWDSNGHVSVYVLETTGMRAFSAPDDGDMTNYVPLASYNVGVASSIFYDYDAHIIYTGTSSGATAADAGKDKVSRLNLSTGTVDNSWALGFSKISGLGMRAGQLLVLDDAGQLNNPPATGQGKMSLLGGVVAQITSGPTLANGSQSPNPAFTNDTTPTFGVSADPSGSALECSVGGAWTDCTSGTYTSAVLANGPQTFSVRPAPGGVPVSRTFTVDTVAPAAPVFTAPNSGQVVNGKPVLGATFEPGTTLSCSVDSTADADFKACVPGDTFTLTTEGAHTLRIRSTDPAGNVGPAAALTVTVDLTAPQVAITAPASGATVGAGYQFQFASTSPDIAGFRCRLGTDAFTECTSPKVYADIANGPNRFEVEARDKAGNTTVAGVNFTVFVADTTPPTVTADPVAGTYGPSSKIALTASEADAKIYYTEDGSTPTTASTLYTAPIAMGSKTLKYIAVDAANNASAPQTQVYVLDNVAPAVTANPTGGNLALGQSVTLTTESGAKIYYTTDNTTPTVASQVATTTVTITPAATTTVKYFAVDAAGNQSAVASQTYTLPAAPANTWKDYNSDAKNDVLARDSAGTLWLYPGNGTGGWLGKVNTGTAWNNYNLIVPTRDFSGDGRSDVLARDGAGQLWLFKGNGTGGWQPAVSVGSGWSGMTAIVAPGDFNGDGKSDVLARDAAGVLWLYKGDGLGKFTAGSTQVGAGWNVMNTLFSTGDFNGDAKTDVIARDTSGGLWLYPGNGTGGWGTRTQIGSGWGGMTALLGPGDFNGNGKSDVLARDASGNLWIYPGNGTGGWLAWSQVGNGWQGFTSLP

SEQ ID NO: 2458 - protein, 972 aa, Arthrobacter sp.
MVVDRPKYARRHTHSTLYSTRSLFRKILVFLLGSAVAFSALTLGVAAPAAAAVPPCPGTGGAMQIVAHTDDDLIFISPDFMRDIQSKRCVQTVYATAGEAGEGAAYWNSLEAGIRASYAKMAGVADAWTTSDAGVPGRPLTLQTLNAAPNVSVVFMRLPDGFPDGRGSSRYNGQSILKLWDGRLSSIRPVDGAAAFTKAQFQTTLNQLVANYQPTTFRTQDWTGNYQDPYDHSDHWATAKFAQLASRAYTGPHTASAYDAYVIDEYAQNVTGADLTNKVNTFVRFADFDKYLCDTPCPAPPYSDWLKRQYITAIEWTGNAAKSAGTTVSASSQKASGQSPEKARDGYAWGTPMDANREWVTNGGKAGSWIQYNFSPARTINAVTLFDRPILSDQVTGGNLAFPDGSTVPVGALPNNGSGLTVNFPARTVSSVRFNITSVSGSTTNIGLSEFEAHITADVVAPEVTATPPGGTYDIGQKVTLSANEPATIFYTLDGTTPTTASAKYATPITVNGPLTLKYFAVDAANNPSAVVTQSYSTGPDVTKPVVTANPLGGAYAPGTSITLTSNEANSVIKYTKDSSDPLTAGLVYSTPIVFAGPDPMTLKFFATDPAGNVSDVVTQTYNVPPDTRAPVVTANPTSRALASGATITLSADEPGASIYYTTDGSSPTATESATNFKYSAPLVMGTSQLTLKYIGVDAAGNTSPIGTQTYSVPAAGPPSSHDFNGDGKADVLSSDTAGNLYLYPGNGGGGLGPRQTALAAPAWSTITDTITPGDFNRDGKPDLLARAGDVLWFYPGDGAGSFGARVQVSTGWSTMSQLFSPGDFSGDGIPDLIARRSTGDLRLYEGNGSGGLRTPITIGTGWNVMNAILSTGDFNGDGTGDVLARRSDTGALWLYPGDGTRGWLAWKQISTGWDNRTSIAGPRDLDGDNKNDVIGRIGDTLWLYPGSGNGTLSNVPPTSLGTGWQAMKIIG

SEQ ID NO: 2459 - protein, 914 aa, Arthrobacter sp.
MMKRKFLDPVGRIPMVRAGLALTVALTAGSFLCAPAWAQTSGPQPAPTSEAPGGGSSQGPQPAGNGPASPPVESTPRQGKLPDQQAPITGVELTPGVASQPAPDPAGKAEAQATKPKSMPGDAPDAESMKAAMRAAIPAGGAEMGQRSPRVVTNKQDKEAAAPARGKAVGAAVKATVPMAADTGHWRPTIGIQGQDVSAHQGNVDWQSQWSQGSRWAYVKASEGNYYLNENYTQQYNGSRNVGMVRGAYHFAIPNWSSGADQARYFVANGGGWSADGYTLPPVLDIEYNPYAGRTINGFYFGNTCYDMSKAQLGQWAADFGNTVKALTGRFPVIYSTTDWWNTCVGNSTFGSYPLWIASYWNNPTNSPGSLPASWNDYSMWQYSSTGPFEGDSNIFNGTFDELRTFARGVPTPSNPSIRSGADVLAVMPSGRLDNFPADGQGRISGPVTIGSGWGNALSVHVVDWNQDGVQDILAQWADGTLQVFRGTSGGGFSTPIQVGSGWQEMSLATGWWNSKDAFPGVIGQDGSGNLYRYQNASGGALGGGVLIGTGFSGHQFNLLDFDGDGSQDLVSRTGDGTMRLFRSNGLGSFLTEPARVIGNGWSAMTSVSSAAGFNGSGSQGLQARAANGDLYYYPAVNGSWGNRFLTGLGWNDALLIGGAPVNVEATLGVDEPDVLAIRQDGNLYRYAGSGSGGLTSPELIGKQWTGLKAGFLTDWNGDGALDILAQWSDGRLTLYPGFKGAGFGSPISLGTGWQDWTLTVGTWKKSDPRPSIVGYDPAGRLFQIGNPSGGALGTRTQIGTGWSGLDIVQMDFDKDSNADLLAKTASGDLMLYRSTGTGSFIPEAPAAIGTGWNVINSFGAIRGFAGAGSTGIIGRTTGGELRYYPVGQNRAWGPTSVIGSGWTGLKILSPASR

SEQ ID NO: 2460 - protein, 521 aa, Arthrobacter sp.
MQVQDRPGTPRNARRRVAACAVFLALVLAAALAPAAAAAAPASAAPTAQATRYVSEAGVTAHRAAVVNAAAVKAQVPSTANPLPGLDPAGDPANLSVLVNKSRPLNPATYAPADLVNARGSGQYLRAEAAAWLNGLFQGAADAGTGGLAVVSGYRSYAQQQQVYSSYVNLYGQAQADLISARPGYSEHQTGLAVDVGNANGSCGLSTCFGDTAAGMWVAANAYKYGFIVRYPNGYTNITGYSYEPWHLRYVGVDLATDMKRRGFATLEQYFSGNPSVHASITSGADLVAADAAGRLLRYPALPSGGYGVPVQIGSNWTGLKQAFVVDWDSDGVYDLLAQWNNGTLGLFKGWPGGAFSTQIVVGTGDWDAMTITVGKWSSDQGYPGVVGYFPDGGLRYYPNTSGRALTYRVDIGTGWAGLGLTMADWDADGANDILATTSSGLLLSYPGNGVGGFKGQPSIIGSGWGTMKALVPGFGLSGPGTRSITAQTVDGYLVDYGLGLGVWGPQRQVGNGWGSMKLFK

SEQ ID NO: 2461 - protein, 155 aa, Bacillus sp.
MSIEVGSKLQGKVTGITNFGAFVELPGGSTGLVHISEVADNYVKDINDHLKVGDEVEVKVINVEKDGKIGLSIKKAVDKPERPERPERPARAPRSDRPRDSRPQRNNNRGGGNDFRTKETFEQKMNRFLKDSEERLSSLKRHTESKRGGRGAKRG

SEQ ID NO: 2462 - protein, 337 aa, Bacillus sp.
MNIKRWLLTATTVILATSGVSSVPSVHASEEKETAYIDVAAATLWTAPNILREVDAPSATNPVDMKKWTTSMDLKQKQQLSSDGMLETQALYGNKVTVLERQGDWVKVAVDGQPTSRNELGYPGWMPNKQLTYSKRYDQYAKDPFVMVTAPTTYLYHSPYLKKKGIEVSYNTRLPLLTKSKRAYKVLKPNGKTAWISAKAGKIYASQKDIPVPTGTELVESGKAFLNLPYLWAGMSGFGFDCSGFTFTMYQSHGITIPRDSGPQSRAGKPVDMNNLQPGDLLFFAYNQGKGSVHHVAMYAGDGMMIHSPNSERTVEIIPLNTKGYIEEYAGARRYLP

SEQ ID NO: 2463 - protein, 109 aa, Bacillus sp.
MHQFLHSMKHYAIFFAVIAALTYVLTLVLGADKVDLDKYSTVTITKGDTLWELSNKYHNHHHLTTNEFVKWVEDVNDLNSDTAQSLSPGDKLYIPVLKKELHNQVAIEQ

SEQ ID NO: 2464 - protein, 426 aa, Bacillus sp.
MQNRYRHIIGAILLVSFIFVGFIPVVQQYIHIPKQIVLFEQQKEKINTTLPLSVEASSPVYDVTSNKAKLTVAGKQVGKEELMLHLAGIPVKRVDVQVLSDFKVIPGGQSIGVKLNSKGVLVVGYHQVDTAKGKKSPGEIAGIQVGDMITKINGKTIEKMSDITPFIQQAGKTGEPLNLHILREKKQFDTKLYPLKDKQDYAYRIGLYIRDSAAGIGTMTFYDPKSKKYGALGHVISDMDTKKPIVVEDGQIVRSTVTSIEKGSNGVPGEKLARFSEDRQIIGNITRNSPFGIFGKLSSTMENGIMDKAMPIALSHQVKEGPAKILTVVDDDQVEEFDIEIMSTIPQKFPATKGMVIKITDPKLLKKTGGIVQGMSGSPIIQNGKVVGAVTHVFVNDPTSGYGVHIEWMLNEAGIDIYKNNRKKAS

SEQ ID NO: 2465 - protein, 137 aa, Bacillus sp.
MIRKWVAVCVVFAAFIFPQAVSAEQPKVEVFQIETGKVVRSTPKPPSVQKEAEKSITSITGLYKKASPLPKKGYLVKVPLDPAVKIENSAVNTLASEVIFVLEPNQKPIMMVFDNENRTYFFEFTHDLTLLRKALQL

SEQ ID NO: 2466 - protein, 501 aa, Bacillus sp.
MKKICMSLIILCLFSGGLAPMSKGAAASSVGTVKGDNVNVYRSPSLHSSIVQTVKKGEEFPVISSEAGDAAQVTTHTVVPGNTLWLLAKQYGVTVSDLIKQNQLKKTELIPGQTLKIPAKGLLHKVVSGDTLWKISVKYGVKANELTKLNQLSSTNIKPGQMLIIPDYYVQVQLLEGKKGWIKKSDLAQKKHQPVVMGWSFNEKAAGYTESMKQKNLDVVSPRWFTLTSNDKVVSSSINESYVQTAHKNGKKVWPLIGNNFDDVLTSDVLSNKAKRQKLVSSVESSLVKTKSDGINVDFENINIKNKQDFVLFIKELKAALKSHGMTVSVDVTRENNDPFWSGSFDRKQIGQVADYVIMMGYEEHWGGSQVPGSVASLPWVKEGTQLLMKDVPAHKILLGVPFYTREWKTDLSTKKVVTKDLTMKEAEAVISSKKLTKKWDSQTSQYYVEYTENGTKHQIWLEDKASMQRRVNLIKDYHLGGAAAWYIGSETSDIWELYNF

SEQ ID NO: 2467 - protein, 33 aa, Bacillus sp.
MANKQQKSQPKNKPETKTYGDPKKLNGPNQPST

SEQ ID NO: 2468 - protein, 255 aa, Bacillus sp.
MKWCFSIIIIVSINFYGIQADAAKKSRFYYEKKGDIVWEVPMKDEKLIALTFDDGPDPKYTPTILNLLQKYGAKATFFVVGDRITSFPKLAQREVREGHELANHTYSHLKVRGQEVERIEQEIEKADERIQAITGIKPYLFRPPTGYYDDRVVKAAKNQQYTIILWSWHQDTFDWRNPGVGKIVSQVLNHARSGDIVLFHDTGGDRTQTIEALKQILPKLKEEGYKFVTVSELLKHHPNYKSLYLMQQQKQHSVQ

SEQ ID NO: 2469 - protein, 191 aa, Bacillus sp.
MFKKLVIIGALAVPMFGMSHGANAAETTHRVKAGETLYKIGAEYGVTVQQLKEANHKSTDSINANETLTIPNSISESDKELLARLVQAEAKGEPYAGKVAVATVVLNRVDSDSFPNSIHDVIYQGTQFTPVQNGEINKAADAEAKKAVNEALAFRGQGKGSLFFFNPDKTSDQWLRQKQVTITIGNHVFAK

SEQ ID NO: 2470 - protein, 434 aa, Bacillus sp.
MGQVRVDPDKLESAANSMSRNRESMESIIRELLQVTFELQMSWEGMAYQRFFDEFFSKKRSMDDLVKHLHHTELELKKAAKTFREADEKAFGDFNQMGKLWDAFQRGSGKAAGDTIFDPLKKGWNQTSDFFGNLVDNPMDALEDAKYGLTDFVESSIDDTKEEFRDKYEFMKDMWNNPIGTLKHELDEEVQEMYAIRNVLSDWYVENIKYGDAESITESVAYGATNLAFFGLVTRGASAVGNGARWGKNLSSISKLQLENRLEPAFAYGKIDYKVDTIKPSDTYMFAKTSSAVKRKTPGTVTSSFNLERSLGTQKKLMYNDCAIGIIPQEVREKLVGREFKSFDDFREEFWKTLSDSSYAKEFSPMNIKLMKQGKAPYSPRAEHYGNHNKYILHHKQPIDKGGDVYNLDNLIIVSPKMHQNVLDPAYHFGTKGL

SEQ ID NO: 2471 - protein, 333 aa, Bacillus sp.
MIRKIVPFLAVLLVMSTLFNVAPAEASTKQDQLVTEAKKHIGVPYRWGGTTTSGFDCSGYMQYVFNQIGINLPRTTSQMYNTGTSVSKSNLQVGDLVFFNTSGSGVSHAGIFIGNNQFIHSASSRGVSISSINDPHYWGSRYIGAKRVMTNTPVRSLGSGEFYDVATNHWAFSEIRQLSNNGIIGGVGNSNFAPTDQLTRAQIAALVVRATNTPLTTTANGFNDVSQSHWAAADISAADRAGFFDHIQGDSFNPNANVSRAEIAVIFSKAFDLQANGSSASAFSDINSSNWAYNEINALHSNGLVQGFTDGTYRPSSSISRAEFAKILHGALY

SEQ ID NO: 2472 - protein, 111 aa, Bacillus sp.
MGKERGYYDVVYHQFSVEADDSPIITNSINVFVGKTTLTNDTDLEQTLSTNSFEKIFVNTITNSTTSGYNLGVTASAKFSILSIFETGIEMSTEYDFSNTSVTEKKTNINI

SEQ ID NO: 2473 - protein, 129 aa, Bacillus sp.
MYSTTFNIGQINKAFVFFLAAAVLCGCGKADDSAAKKALPVTLHVENADGSPAAGVTVTVMKAAESDHQPNIDRGEIIGKTDHHGEMTWKSGAKGTYAVVFEKDGVPETRNISLAESDKHTVISITLKH

SEQ ID NO: 2474 - protein, 297 aa, Bacillus sp.
MAKRIFLFILTNLLVITTIGIVLTIITSVTGVGSYIQNGRIDLMALLVFSLVVGFVGSFISLGMSRWMAKTMMGVRVLNPKKQSLSYEEQQLVDRVHRLSRAAGMTKMPEVGIYHSPEVNAFATGPSKRRSLVAVSSGLLQQMDDAAVEGVLAHEVAHITNGDMVTMTLLQGIVNTFVVFLSRIAAWVASRFVKEDLAPVVHFIAMIVFQIIFSILGSLVVFAYSRHREFHADRGGADLAGKDKMIHALRTLKSYSGHVNEEDQTAVQTLKINGKKHSSLFSTHPDLDERIRRLEAK

SEQ ID NO: 2475 - protein, 420 aa, Bacillus sp.
MNTVIAFIIIFGTLVFFHELGHLLLAQRAGILCREFAIGFGPKIFSFKKNETVYTIRLLPVGGFVRMAGEDPEMIEVKPGYTVGLLFNKEDEVEKVIINQKEKYPDALIIEVETADLEHEMKITGYEQGKEDELAGFTVSQTSFFIVDGEEVQIAPYNRQFGSKPVWKRIKAIAAGPIMNFILAYVILVMLGFIQGVPSNQPELGKLTDNGRAAAAGLKEGDYIQSINGEKMRSWTDIVTAVKENPGKKIDVAVKRDGKSFHISVTPEAVKDENKKTIGRFGSYAPTEKGALAAIAYGATSTVDVTKAILTNLSKLVTGQFKLDMLSGPVGIYDMTDQVAKTGIINLFQFAAFLSINLGIVNLLPIPALDGGRLLFLFIEAIRGKPINRDKEAFVVFIGVAFLMLLMLVVTWNDIQRLFL

SEQ ID NO: 2476 - protein, 103 aa, Bacillus sp.
MAKESIIFVGLFTAILSAAILLVSCAGNDQSLSQYVKIKVQDGDTLWSLADHVAEKKHINKEDFIEWVTENNHLQTADIKPGDELILPVKKKHPAVYQLAIVN

SEQ ID NO: 2477 - protein, 215 aa, Bradyrhizobium sp.
MPSSQPIRQARPWLVFLLLLAGSGAAPAAPLPTASLHVGTTYARWLWPVQAVRGQTNAASVSLQILPSQTVNVGGKVSFGVTARRTGYLILVDVDAEGRMSQIFPTPELLAQSNERDINLVKPGVEFVVPAPAARQRGFEYVVAPPAGSAVMIAILSERRVQLLDLPDMPRKLEGQADALSYLSAWTSELRVPDNSSGKLVTNNWSFDVKSYSIK

SEQ ID NO: 2478 - protein, 82 aa, Bradyrhizobium sp.
MITKTVLAAAGVVCLLAAPAMAQTTDKEKNGHHYSGGPKTEVPHHMGKKDTTGSSTKATSGGHHYTGGPNTSTPHHMGEKTK

SEQ ID NO: 2479 - protein, 113 aa, Brevibacillus sp.
MFYNPYDYNPHYDDPYHYVEVQHRVNRFFEHIDGKGASFTLNSGERLSYVGDAWNDRISSVRVAPKTLVVLYEHINFTGRKKLLENSSNRSHLFNIHEDFNDITSSIKTFRLC

SEQ ID NO: 2480 - protein, 138 aa, Brevibacillus sp.
MSWRKSTQFGGDGGSPFSDDLTNVKRLAGFYIRHGSRIDAIQGIYEYSDGRRTPQGFHGGYGGSHNIVFFENDEYIIQITGRTDRRVDQLTFTTNKRTYGPYGGDGGNPFEIDAAHISGFFGRSASELDAIGFFIPTV

SEQ ID NO: 2481 - protein, 317 aa, Brevibacillus sp.
MKKFASLILISVFLFSSTQFVHASSTDVQERLRDLARENEAGTLNEAWNTNFKPSDEQQFSYSPTEGIVFLTPPKNVIGERRISQYKVNNAWATLEGSPTEVSGTPLYAGKNVLDNSKGTSDQELLTPEFNYTYTESTSNTTTHGLKLGVKTTATMKFPIAQGSMEASTEYNFQDSSTDTTTKTVSYKSPSQKIKVPAGKTFRVLAYLNTGSISGEANLYANVGGIAWGVLPGYPNGGGVNIGAVLTKCQQKGWGDFRNFQPSGRDVIVKGQGTFKSNYGTDFILKIEDITDSKLRNNNGSGTVVQEIKVPLIRTEI

SEQ ID NO: 2482 - protein, 836 aa, Burkholderia sp.
MNRTLLLKAALIAAAVLPAAAGAQSAQTFNAPMPGAPATPDAQARPPGGILSPFLLSAQLGRDLMLHYAIDNNNANAAGVPCADLGADSASCATGRLILENRGQARISGDGWKLYLHSIRRLLRIDHPGFTLRHLTGDLYELTPKPGALTLAPGARLTVPFVAEYWFLRYSDLLPRPYVIVPGALPTVLRHNDTDDETRYVDSLPADAQSSSTGNAPPAAVQPVASRALPSVKRERLGNDTVELRGVQLALTGLAANHVAALRERAGELGLGGSGLPVRGSIVPQQLPADIAIPGGYRLSITRQGANIEAYDQTGLYYGVQTLFSLTPAGGGRIPAMQVEDAPRFPHRGMHADLARNFKHADTLRKLIDQMSAYKLNRLHLHLSDDEGWRIEIPGLPELTAVGSRRCHDPSETLCLLPQLGSGPDNRSGGGYLRRDEYVSLLRYAAERFVDVIPEIDMPAHARAAVQSMEVRYRLFHALGREREASEYRLIDPQDTSNTLSVQFYDRRSYLNPCAPGSLKFATKVIREIAAMYADAQAPLPIWHFGGDEAKNILLGAGFQPLNGTDPNKGRVDQAAQDLPWARSPMCTALLQRGEIKSTEELPTRFAQQVSAQVAANGIGTMAAWQDGLKHANGPQDFSTRNTMVTLWDTLFWGAADSARDWSAKGYRTVLALPDYLYFDFPYTTNPRERGYYWGSHATDEYKVFSFAPENLPQNAEVIGDRDGNPFEVTGTGAAPRLEGMQGQAWGEVMRNDGEFEYMVYPRLLALAERAWHRADWERPYAAGVRYKLGDTHLVDKDALNKDWAGFATVLEQRELPKLGRAGIGYRPPTFSLSGS

SEQ ID NO: 2483 - protein, 250 aa, Burkholderia sp.
MSIQSFSKQAKHARFVRMFALLPICAAALTAGVQEACAHGAIGTPIARQYQCRLEGGYWDPADGSGIPHTDCRAAYQNGGNSAYPFTQWNEFSANPIGQGDDLEKLQQAVPDGLLCAGGDKKKSGIDVPAVAWRKTRVTPVGGKIDVTWENTQSHTPSVMRIYLSKPGYNPQQPLRWADLDKIYDAPAPAPQPADGGGRLPGTVTSFYKLSVPLPAGRTGDAVLYSYWQRRDAGNEGFFNCSDITILPGR

SEQ ID NO: 2484 - protein, 139 aa, Burkholderia sp.
MQQQHVSKFLLAAALALGLAGGAYAQSGLPDVKQQGDVSYVSGGVGLDESNAFQRAEHQWPLSIRFTGAGGEYLSGVHVSIMSHDGEVLKADTRGPYMLVRLAPGAYKVSANYNGKTEMRNVTVPAKGDAKLAFSWAAQ

SEQ ID NO: 2485 - protein, 618 aa, Burkholderia sp.
MRTRLPRLASSALLALPLCLNLPAHADTVAANTSTPLAATPPMGFNNWARFQCTAQAPTDGSARANYSFQHFMLDQAEAMRATGLVASGYTLLWVDDCWMSRIGSGQIQGAARWGGSQQPGFDPDLGAYVSAVHAKGMLAALYNTSGAKTCQGVAAGEQGHQLQDAQTYVAWGVDALKLDNCGAIDNATPQQLFKQMADALGQASAGSARKILFNESAPAGYGPTGSAKYATLDWVRPLGQMWRTGPDIRTTSMTAGGQAASDPWDYYNANAYQEGVYQSYNETIALSRYVSPGNWNDPDQLLIGDNGLTPAEERSQMALWSAMAAPLILSTDVRKFAANPADPRWQQSLATLNNAEVVAVDQDRLGIGGYRVSRDDPSSSAGIEVVAKPLADHALAVVVLNKGAASASPTLSFSNLGYRNGADGTPCTLAVRDLWAHSGSQLAAQVPLTIGAHDNAMLKLSGTCGGWAPTGEIETVGDWGATPLCIAAGSAAPGAALALANCDAGPKQRWSRKADRTVELAGTGLCLSSTAPGATLGGAAGQWATLASCNAQDTKQQFSYRRNGQLAAAADGTCLDIYRGVVDGTLGKPGTPLDLYACTANQVNQIWAAPHADVLND

SEQ ID NO: 2486 - protein, 568 aa, Burkholderia sp.
MQTARKALPLALSIALGLGMVHGVAAQSKTGNPQAENLRESLTRGVAKPAAGGEAAPSSTGAVSVTLANPAYRVKKTASTPEATARDFLATQARQLGLDATALAGLELVSQRQDPDFTVVRLRQVAAGLPVYGSEIAVTIGKDGSVLYVASNAIGGVAPKASKTQAVDQQQALDRARSYLGIGELRNAEAQLVAFRDAAGTHTAWKVRGRPDGGPKGDWELLIDATSGEVLRAEDKAFYATDGSGYVFRPDPLSSTKSSYGSTGYKDNNDADSAQLTAARVRVTLKDLKQSGASYSLSGPFASCIDFDAPRDNACPVQPSPAFEFTRGNLYFEAVNAYYHIDTFLRYVNQTLGIKALPYQYTGGVQYDPHGESGDDNSSYSSSSGRLTFGQGGVDDAEDADVVIHELGHGIHDWVTNGGLSQSEGLSEGVGDYLAAGYSRDFNQWSPSDAQYNWVYNWDGHNEFWPGRVTNYNVGRTYAQIRSSEIHTAGQYWASCNLVARDAIGGQAMDKAFLKGLSMTNGSTNQKAAAQAVITAASALGYSSTQINAIANAYNKSCTYAVTVPQKS

SEQ ID NO: 2487 - protein, 258 aa, Burkholderia sp.
MRRTIFTETTTYRRAVSRATLFAVGAALVGGCTMTPWTDSWQPTSTPQPSRQNQGGVLAGYYRVNPGDTLPSIAAGFGQRSQDVASWNHIAPTDMLTPGQVLRVAPPPGNTAITSPVPSSGQPSSSALPGATAAEPPALAWPAQGTVTSRFIPGKTRGITITSTGDKTVRAAAAGRVVYAGTGVAKYGPLVILKHESGLITAYGHNGKLLVNDGDAVAAGQAIAEMATDPDGRSSFDFEVRQDGKPVDPIGFLPRNGG

SEQ ID NO: 2488 - protein, 241 aa, Cellulosimicrobium sp.
MTRSALRVLSAALVAGLALGAAATAPALATEPDLRVVTWDRGPDPAADAQVSTGESCAVEAQPLLPGQDPGALPPAPEVCFGSLEEALEFVSGGDVASSRLADVTAAEVEGLVSDLNASASSAAAGQRLAGTERATTAAASSLVLGVLWRDANYKGTSKVLYGSGTNGCYTGSTYGFPNLANLLMNNVVTSATTYAGCWVTLYDSYGYAGAKKNCTPHCATLGTFDNKASSVVYRPVGQLG

SEQ ID NO: 2489 - protein, 370 aa, Collimonas sp.
MENLMRLTRHSRWQGVKRYAAVTLPVLFLAACATQEPTTSGTQNAASTGKPILAPKPAAPAVTPQQAELKSLVALQDRLYDVAAPLLVNNAVLCRNNARNLLGFTAKTKFSYTAEFIDAATSLGLTDQLQVTGVLTGSGAAKVGLQRGDLLVAIQDKPVPTGADAERQTALMLGPLVNGRSNIKVTIARNGSNQTLNVPLTRACAFGIELGNTDNVISYADGRRVLISAGMMKFVRSDDELAYVIAKEMAHNTLTHPARQRLTATLSGVIDNLVRLRPDNAPLSGAAGVKPYPQQLDAAADKLALYMVARAGYKVDDASAFWQRLATQYPATVLNGYTAIHPATTYRIAAIEQAVSDIQAKQASGSTVLP

SEQ ID NO: 2490 - protein, 653 aa, Collimonas sp.
MSNRNQKMSRYVGISLLTFSCFVFIPAAGAGQPLATTYPNGEIYNYPIRSIISFASSVDVIGSKLAQSLSSSVFQGESLDEKTLGSSFGGRHNTTLTYLDGATILSNVNSLKRSKILLDAGVPLLIRVDRNQLEVGKQVAALFGVSIRSGYMLLSKDGPAKLTVFNLQAPDNTAIPNGLMQALGAVKQKNVLPSLRANIRALETDQVGIPKVTLNLNSADVTGQIVSIVNLDLIRSASRGNDKKFIVVKATPTVRSTRNGVVIGSAPNNNLWGAYLPHQYSISHEVSGTALTPILVSSDPPSDSRTEFTYTETKTHGFTIGGSFGAEGGGEHTDKWKYIAKTPFNINAGISYTNTKTLTNIFKDYSLLAAPAIGKIKWDLFIDPKLKFVLVERETAGLPTLNENRMTPMMRSASMETYSTWELPGNYEGLATLKIGGGYILDRREWWYDRSDVKRRYETDTFETLDDIILDFGSPYLTREMTVLIRSADGHGKCVGDQSGQAKLLSCSPADKSQLWGLDSESRYVNRLSGKCLTADVQSGELKTAACGIDNAQQWDWRADRIHSRYDRNWRLYSTADMLKVIPDSSMLFEDIPLNSFNRLNIPWASYPGAPSANDVMPNLNGPSPQISPDWIGKYHAADARQRWNIEILRDGI

SEQ ID NO: 2491 - protein, 208 aa, Collimonas sp.
MKQISSSLLVLLALASPLTAQAHGYVDAPKSRAFMCKAQENTACGAIQYEPQSVEGAKGFPDAGPADGAIAAGGLAQFAELNEQTPTRWKKVALTTGANDFNWYFTAGHMTQDWRYYITKQGWNPSQKLSREAFDLQPFCVIKGGFAPGSNTHAKHRCNIPADRSGYHVILSTWNIADTGNAFYQVIDAQIQAGATMNPQKVIINPFK

SEQ ID NO: 2492 - protein, 332 aa, Collimonas sp.
MLGLALAVACFFFSHLAAASCLDGNRMTGVNLSGAEFAADKLPGTIFKDYVYPDPADMRHFQSLGMNTFRLPFLWERIQPQLLGPLDEAEVHRIEETVAAARSLGTCVILDVHNYGEYRGKPIGSTEVPRAALADLWTRLLARFKDPENTAFGLMNEPSKLPVAEWAAVAQETLNILRKKGSRHLILVPGGSWSGAHSWFAKDNGVSNADAFRRFHDPADNYMIEVHQYADADFSGTSNTCVDPARLGAIMADIAVWANSTRRRLFLGEFGVPANQQCLQALAAIMDGMKGNSAWGGWTYWTSGKWLGNYPFSLQPDSNGDKPQMTILKTGM

SEQ ID NO: 2493 - protein, 92 aa, Dactylosporangium sp.
MNTHRRRRRFGLAVATVVTALVGTGVAVLNMTSASAATVDTSATYVLVNRNSGKALDVYNFSTADGARITQWTRSDANNQQWQFVDSGGGYY

SEQ ID NO: 2494 - protein, 287 aa, Dickeya sp.
MSIKVDITASSDNHQTIATATGNDISVISNEERGTFQLNDQQLKRAVEVYFGKKPNDAYLSSPTPWGDLYKTYNWQQVMRTLQPVSTRVISQNSTPVIVMEQDFVNNSSVPAVYNVKISQSVQNTVKSSWNTGGKLTVGQKVKYGISFLGTGGGGESSISYEQSWGIGGEQSTTITLGTESGLQVTLQPGQAVTAELVASRGSMKVQVDYQASLSGISAVNYNPTYKDHHFWGLPITQIMRSSNISNAIVSSEIIDIGFYADSKVILRDKNTGGVFRTFNLFDKHTD

SEQ ID NO: 2495 - protein, 111 aa, Duganella sp.
MKRILGLALLGAAAAAQAGDITLYTRAHFGGPALQLHGSEPDLDKLGFNDRTSSVIVQNGTWEVCENKHYKGKCLILEKGEYAELKNFNDMMSSVREIEARPAAKDKPEHK

SEQ ID NO: 2496 - protein, 454 aa, Duganella sp.
MHCKPLILTALSVLAVAPAIAAGPDTSRHQAQIDQIVKDISPVRIEGYINKLVGFRTRHTMSDTVSETEGIGAARRWIKSELERCGAAQGGRLQVAFDSHIAPVSARISRPTEIVNVVATLPGTQAASVDRMYVVSGHYDSRNTDVMDAKGDAPGANDDASGTAAVMEMACVMAKYKFDATLVFMTVAAEEQGLLGAAHWAELARQKNLNIAGMFTNDIIGSSRDEHGKVDNTQVRLFAEGLPVQKENSDAVRTLIQTGGENDSLSRQLARAVKEAGERYVPKFKVNVIQRRDRYLRGGDHMPFLERGYAALRFTEPAEDFNHQHQNIRTENGVLIGDLPQYDDFNYIAQVARVNAAALSSLSLAPAAPAKVQVRTAKLQNDTELVWQANAEPDLAGYRIVWRDTSAAEWQGSQFVGKATEFTVPLSKDNYYFGVQAIDTEGNASPASYPTPLR

SEQ ID NO: 2497 - protein, 408 aa, Duganella sp.
MTTTTAPKLALAAAILLAYSAPSLAASTCDRYASYPVKGGTYTVITNFWNDKASGSQCVNVNQDNGEWSVSSAPSSPDSTPAAYPAIYKGCHWASCTKDSGLPLQAKAITYAPTRWRVTPGAGGDWDIAYDIWFSSGREAPPSGQPDGAEIMIWINHSGSVQPAGSKTANVNINGMNWDVWTAWNNPSGWPRWNIVSYVATSPVNAVNFDLVPFFRDSVGRKAVDNNWYLLDVEAGTELWRNGAGFASGDFDVQFHTDPVKGIDPNKWYSVVNKNSGSCVDDADFSTSNGAVVHQWACDSRGAANQQWKFTPTDSGNYRVSTQQAPGLAWDVAGWGTANGSLVQLWTYGGGSNQQWQAVDLGDGYYKFVGRGSGKCLDVPAASTSNGVQLQVYDCNGTPAQSFKLIAQ

SEQ ID NO: 2498 - protein, 270 aa, Duganella sp.
MNKPLNIAMAIATLTLASQAMAQITFYENDGWRGRTFTANQQVRDFTRNGFNDRASSVVVDRGQWEVCDDANFRGNCMVLRRGSYESLRGMGMNDRISSVRPVGKRNSYANEAPAPLPQPTYEYRRRPSERLVEVPVTSVRAVVGTPEQRCWVESQQVAEPARNGTNVGGVIAGALIGGILGHQVGGGTGRDVATAGGAVAGAAIGNNMANNSGQQSYARDVRRCENVSNPKPEYWDVTYNYRGQEHRVQMSTPPGQSIAVNSNTGEPRM

SEQ ID NO: 2499 - protein, 236 aa, Duganella sp.
MKNTLTAAFLLAASIVGQAASAGELLLFSHEDFRGERVTIADGAASNFTDFGFNDRASSIVVRSGTWELCEHKDFGGQCAVFERGEYPNLRQFNNQFSSAREIQGGRRDRGNSGYGYGRDDRDYRDYRDERREERRDGRWMEDRREERRDYRERGDAVEMYNDVGFRGRHVVINNDMHTLRDVGFNDNANSLVINYGTWQVCEHADYGGQCRTYGPGRYPNLEDFIDRISSIRRVR

SEQ ID NO: 2500 - protein, 141 aa, Erwinia sp.
MRKVIVMRKRLSMPLVAVAAAVATVVPASAAHAADGYDRCPDGYYCMFSGLDGTGDMIALREDTPDLAALGMNDRAKSDWNRTASTIYLWSDAQYTGCTAVTSAGPTGKGNFFPTYQDFFSSVQFDGPGGPSCGTPPGEGR

SEQ ID NO: 2501 - protein, 602 aa, Erwinia sp.
MAIFDYKGQDGRVLISDAWNLATYTSGVATVGALYNLPGAVLGEGNTFVLPKGWREISASDLGIDGSHLDLTGSFKGENVSGSQAKVFGQYDESGKLVKMGFSIAGTNSPMDLLGYPAMIDNSYIHGYDYLLDSIKNYATNHNLTGKDVLVTGYSQGGSVTNSMYLGRDTLADGFFKDSDYFGMASPKASNSDGIFNFGFENDIVHRLIGEQTDLSGAILAALKGSDANYTSTTDNIVLFDTVYALPTWPNGPFSVVNPNGWVAHLEGIFINPIQRIGQSTFYDYIERDSTIIISNLDPVSRSFTWVSDKYSATSNHFGTPAFLLGTDSADKLQDGRNDDFLDGFAGNDSFKVSTGTDIVAGGVGDDKVFLQGTVSSYEAVRLSDGSLFLNDTGGRYGLKELHDVEHVEFEGLLGQALTPAYTVTSSKLNFEGLFGSDKSYAKATEGTQLADLLKGTAGRDLIFGQGGDDLIEGGAGHDLLHGGSGNDTLLGGNGNDALYGGAHNDILVGGLGNDTLSGGVGSDLFVFDQGGFGHDLISDFNVHQNGFDQLVFSKSLFASAAAVISATSQQGSDSLIVAGDSSITLVGFNAAQLSADMISLV

SEQ ID NO: 2502 - protein, 355 aa, Erwinia sp.
MSTGSPVVKLRRIAAVSLVGFWLAGCSSDNAQAPISSVGGNGSANSGGGLISQPPPIVSGSGRAAPAASGGRSENVVTQNGRIIYNRSYGNIPKGSYSGETYTVKRGDTLFYIAWITGNDFRDLAERNNVSAPYSLNVGQQLQVSNGSGGTLTGGNAITAADATAGGVPTQPTTAQMKSTTVARQPVITYSEDSGKPSEGKMLPSAGTNTVATTTAPVSAPTVSSTTNSSTPVGSWRWPTDGKIIDNFSASEGGNKGIDIAGSRGQPVVSTASGRVVYAGNALRGYGNLIIIKHNDDYLSAYAHNDTMLVREQQEVKAGQKIATMGSTGTSSVRLHFEIRYKGKSVNPLRYLPQR

SEQ ID NO: 2503 - protein, 543 aa, Erwinia sp.
MIKLGLLLAALLSTFSTLAANLSDIQVSNGNDRASITLSFGGQPVYGFFPLHNPERVVLDIRQSGVIKGLPLTFSGDNMVKRIRASTPKDKQSIRLVFELTQPGKTRAVTQRNGSTYNVVFTINGTRPAPRSAAVSSVSRPVPADNPFKGNAVTAVSNGNEVAVPGRTVRAVDEAIIVAIDAGHGGQDPGAIGANGLKEKNVTIAIARKLKALLNADPMFKGVMTRDGDYFISVMGRSDVARKQNANLLVSVHADAAPNRSASGASVWVLSNRRANSEMAGWLEQHEKQSELLGGAGDLLANSQADPYLSQAVLDLQFGHSQRVGYDVAVKVIAQLQRVGSLHKRRPEHASLGVLRSPDIPSLLVETGFISNPSEERLLGSSAYQQKIAESIYKGLRNYFLAHPLQSIPKEENRPLQSATAVDVQPNPAPVSTRYAGAVTRHVVKRGETLSGIADHYGVSMAMLRSMNTLKKDVVWVGQRLKVPASGAQSVSASRPQRHKVVRGDSLTAIAAHYGVSPKAIQQANNMKSQNVMLGQTLTIPTS

SEQ ID NO: 2504 - protein, 328 aa, Geobacillus sp.
MRRQLVLALLLGGSVFAAGARAEQAEASVNYDHIVPAAKQYIGVPYRWGGTTAKGFDCSGFIRHVYQSIGIDTPRTATDMYRMGKRVDKSALRVGDLVFFNTSGKGVSHAGIYIGNNRFIHSSSSKGVTISSLNDSYWKKTYIGAKRVLAYRLAPGQFQDVSPSHWAFDEVRTLSEQELVIGYEDSYFKPDEPITRAEVAAYLAEYLDLNLSDRSVPFNDVPDDYWALGAIRAVQKQGIMNGSNGKFHPEDTLTRAQLAAVLTRAFRLQPPAAAKSFTDVPPSFWAFRDIQALAAAGIATGRTDGSFGPNEPVTRVQFAAFLYRAMHQ

SEQ ID NO: 2505 - protein, 364 aa, Janthinobacterium sp.
MATGWLLLGTAQAQSYVYKNLSLPDVDGVARAINNQGQIVGSSYFEGAGNHATLWSGSTTTDLGSLGPSSSAARAINGSGQTVGYSLYSSTSITATSWNAASGSPLALSPGTQSNARAINNAGQIAGYTTAAPGSSRATIWNGNSTTYLPTLGGNDYALGINNHGVVVGDAYFTGSEASHAMVWDGGGVRGLDALGGVGSSAAAVNDNGAIVGSSQLANGTWQATLWNGDTISNLGAPGYDGGQAWAINNRNQVVGYTYTGNNNDSSTWRATLWDGGRMVDLTSFVDSDSRAAGWVLTQAYGINDKGWIVGEATNMQTFSRHAFLLSVSAVPEPSAYASLLMGLACMGVLYGRRVGSTKKNPPA

SEQ ID NO: 2506 - protein, 292 aa, Janthinobacterium sp.
MNRPFAFALLCASSLFVHLAAQAGEIRLYTDDNFKGRVVVLRDTTDDLSRVNFNDTVSSIQVDSGSWEVCTHADFKGDCKTLERGDYRSMPGMNDKISSVRETGAGQGSGSGSGGGRRAALELFADGGQRGASAGVNSDRDDLVDISFNDRASSARVEYGYWQLCSDSNYRGSCRVFGPGSHDDLGSLNGRVSSARLVDPREENRPQNDEGLVVLYGRAFLKGPGLQVNRDVSDLVRLNFNDQAASLAINEGTWEVCTDSQFNGSCERMGPGKYEVLNTTLDKRISSLRRLY

SEQ ID NO: 2507 - protein, 154 aa, Janthinobacterium sp.
MAPDRRGTLNLAAVMLAAGLLLGSAAQAQTDSALPPVQKSGAVEYLSGGIGLDESTAIQSASPHWPLSLVFSVQAAGKAEFASDVKLEIRDAKGGVALETTASGPFLLAKLPPGSYSLHATLAGKALERKVQVKAGSSARVELVWPAGTNQGRP

SEQ ID NO: 2508 - protein, 1605 aa, Janthinobacterium sp.
MNHIYRLVWSSLAQAWVAVAENARAHGKATRAGKLPAALGSTLILLSGAMLIAPTVHAANAADATVTLGSGSVSTVGNTTTIKQNSQNLAIDWVGLSTAANEALIFNQPNSSAIALNRITGSSPSTLLGSLTANGQVFILNPNGVLFGAGSQVNVGGLVASTLGMSNADLQAGRMVFALDGNTNGSVVNQGKINAADGGYIALIAATVRNEGEINAKLGTALLAAGNKVTLNINNGSLLAYSIDQGALNALAENKQLIQANGGQVLMSAKALNTLTTAVVNNTGLIEAKTIENRNGRIMLMGDMEVGTVNVAGTLDASAPTSGNGGFIETSAAHVKIADDALITTRANSGTSGSWLIDPVDFTVAASGGDITGKALSTQLANNGLVTIMNTQGASGTAGDINVNDTVSWSSNSVLELIAQRDINFNAAVTATGTTAGLKLTYAGDYKVKAPITLSGSNSTLNINGNNYTLIRSMSQLDLLDGSNSVTNTGTARQLNGYYALAQDLDAAGTTYTKSLLGSSSSTTFLGTFAGMGHTISNLTINAAGGAGLFGLIGAGSVVRDLGMVGGSIYGANGDVGAIAGRNSGGTINNVYATGMMVGGTTRIGGILGYLNGGTLSNSYSNVTVVGGNSSSGGLVGTNSGSISNSYAEGEISGGGLVGGLVGTNNAGASITQSYASGNVIGNFGGSRAGGLVGLNSGAISYAYASGAVSGDSLVGGLVAWNYPGGSISNAYASGNVTLVVNPALSGTYAGGLIGSDSSTTTNAVWDSSSSGHVSYTGTIGSATNTTDVNAGNRYQHSAYSALGSWQETATGSGVWIAYDGSNNPQWVMVEGSTRPFLYSEWSTTVGNAHQLQLMAANLSANYTLAKNIDLSAAHGSNASGMWNATGFASIGNSLAAFSGTLDGKNYKISNLQIIKPTSDNVGLFGVTAVGSKVQNVGLVSASVSGQTQVGGLVGYNRGELSNVSVQGQISGGISVGGLAGLNMGTINASYGNAVVSSQSGFVGGLVGSNSGRISNSYADGNVSADRDVGGLVGANEATGIIEGSYAAGQVNVYQAGGGLVGSNRGTISNSYAMASVSGVAIAGGLVGVNDGTISNSYANGAVLVGVAGGGFIGMNNGAVNSSFWNSDTNSTGVGAGVNTGVTGINHAQAQLASTFVSAGWDMGTTGGTSTIWRIYDGLSGPLLRSFLTPVTVSATVNSKTYDGSGTMANGYTPVAGVTLSGSLVFTSSKNAGSYSSSDGTLQQGGLSSTQQGYDISYADASLTINKANLTVTAGSASKTYDGTTTASGTINVGTLAGAGDLVNSGGSLAFDDKNAGSGKTVIASGVTIKDAANGDVTDNYNISYVNNTSGSIAKANVTLNVTDVTKTYDGTNNAAAALAVQSGQLYGLDEVTAGSFSFNNKDAGNNKTVSASGVTVNDGNNGNNYNVTVVDSSNSTINRAALTVTANDANKVFNNLAYVGGNGVTLNGLVHGETIADLQGALAYGGTAQGATGAGNYIISANGLSSSNYAVTFVDGTLVIRPAVSVPTGVVPGELLPAYQTAIRNSDSDLRQNNDGKDEDLKVAAFQPPIEKNDAADAARPTPRLTISSCGLQLPADAGNSVCQ

SEQ ID NO: 2509 - protein, 491 aa, Janthinobacterium sp.
MGADAAPESAVFQHKGKARFASKFVSNPNIAGSLNDVLKGSNPEVKKAVSQNILSGFAADVLLKNWDVVGLEFDNILVTKDKKAIRIDNGSAFLSRAMGERKSPASLSELDEIQGLFKPSVNASYAKIAAHAGCASIQDIPNFPQQVKSIVDLRNSGGTDSWRPLVTAWTPGMARRDQDAIINMLDVRTEKLKQLVASPSTQSTGISAKDMKKASGDLDDGIKLKTVIDEYLGPKPKKEDMQKIMQVYNGMVQKIIQHPEVANSDVFKLIWNNPNLLKEGDFEEINPHDTNPHDINSLFKVTDNLKESSDGEFDNCNKGEMVSTLLYTTGLSNKINTALSKNDVPTLNKLSPILNGVSSMIGKGPGYSGKTYRVKEHDGAVLQGFYNAYKNNTAINVPCFLSTTKDKGLARRWEKNKPNESDFTGNTCFHITVPAQVHANGNKARDITKLGEEEEEQEVLFNHHTNFVVTDFKNIGDNKIGNKYLISLTAV

SEQ ID NO: 2510 - protein, 438 aa, Lysobacter sp.
MSNNPLLELMYRGESGAAGYNAYNRGTYTDDAGKERIRGPNGPIDFSQMTLGQVMDRQALPNGNDDRVFAVGKYQIIPQTMRGAVAEMGLDRNQPFTPALQDKVFSEYLIVDKRPEIADYITGKPGATLAEAQHGLSKEWASFGDPNKNGASHYGGANHASITLQQSADALNQMRTEYKANIDKGLSPADAWKATTGDDPNRTLPASITSPGSSQRAPRDAMADGVLKPDERGPAVTSLQEQLNKAGFRDAQGNELKPDGHYGKHTKEAVEAFQRANNLEVDGKAGPKTLEALKNAQPAGPQTEKPAEKPGEVQLSNPAHPDHAMYKQAVAGLEKLGPQAGFKDHAALERAAGTMTYEARVSGMTKIDHVVPNASGTGLFAVQGELRDPASQRVVVDKAQASSQSIEQSTQQLKQDAPTQNQTQEPAQERQQPKTMMA

SEQ ID NO: 2511 - protein, 123 aa, Paenibacillus sp.
MDNKAYVSQTYPRLTVYNEENFRGSRRVFRGNLGIRNTDNILDGIESLRFFSTSSNATLVLFTGTRFRGNFRVFRGNRNIADLDDLIRGNDVESIISTNQRLTLQQIRNIRSSGRLPSGYRII

SEQ ID NO: 2512 - protein, 348 aa, Paenibacillus sp.
MLATFSAALQVKKRMAKRVLKMSGVHGIGVGYRDPAHPKKGAAVIVYTDRLASASTGLLSATALGKKTNVPVRIVKTGKIRANATDYKVRIRPVIAGYSVGTIEGSGSTGLIVAPTGAPATRYLFSNNHVLNPSNTDNREATIQPGGADGGTVTQDRMGRLYRYVRLNPTGINLIDAALSLPTRNNLLNPRYATVGAIPGHVTAYRIGERLKKVGRTTGRVNGTVESVYTDLQINYGGELGLLTFEDQTVIRGTTPVSLPGDSGSVWLRQSDNYAAAVNYAGTADGRLSIAFPVQWAMQVFNTRVARPNGAGRVLRVDTGSSPRSYTRQLTSEELVRLRPRTTRIRRS

SEQ ID NO: 2513 - protein, 345 aa, Paenibacillus sp.
MSRFAPLFTAPVARMSALNIGTCDEEGVNVSLLDQADREIQAKFPKMHSFLLLRHGKLIWERYYNGHEVSSLNDLRSATKSFTSTLIGIAMARGDMPGPETAVHKLLPEYLPRRKETLLEQITIRHLLTMTSGLYWQTGKKLGEAFIHRFHRSKSWPSFALRLPVQEDQLGVFQYRSVDSHLLSVLLTHCCGIDAYTYALQYLFEPLGFGRSGWAQDPEGYTMGHIGLYLTSRDMAKFGDCCLHQGSWNGTELIPADWLHQATQRQVEGYPEFGDYGFQWWTGRLHGINYACAHGHGGQQIYLVPEANAVAVFTADSKVSRWKNPRTLLERYVLPAVSSLNLERS

SEQ ID NO: 2514 - protein, 259 aa, Paenibacillus sp.
MNHRTNHSPKDKRTARRNLSHAVPSPRVNKEKAASTSGSHKSNQRGTATVPAPVEKDTSVQAIEEAAWKKHKLPKTLEEAMQMNRASVLLLSVPESDTEYRLDNDKPSITTEDQAEQDSLLDCSITSIHIAEGRPRPKQRVVLSEQDIDQAFDTAKELNLNVIHDGSATSDEASDDHIASPQYGSIPFHLPAQADRGEVSVVFEKPFIDTQYVITANASILGVMVSVTQRQRYSAVLTVERIHSGPLCEGLVLWIAMGQ

SEQ ID NO: 2515 - protein, 588 aa, Paenibacillus sp.
MKKLLSCLISLGMLVYILPTIIVSANNDGVTNLALDPTSSAQSDIISDAVYKITAQHSGKNLEVEGGSKDDGANVQQWTDNGKEQQKWRVVDVGDGYYKLISQSSGKTLDVAGGNTHDGANVQQWTDNGNAQQKWKIIDAGGGYYKLISQSSGKALDVVGGYTHDGANVQQWADNGSAQQRWRFTQIDTTADTTPPTAPTNLQSSSKTSTSVTLTWTTSKDNVGVTGYVIYNGTDLVDTSTTTSYTVTGLTANTSYNFTVKAKDAAGNVSEPSNVLKVTTSSDSSQNTGFYVKGTTLYDGKGNPFVMRGINHAYTWYKGQESVAIPAIAKTGANTIRIVLSDGQQWTKDDLSALQNLITLSEQNKLVVILEVHDGTGSDNAAVLNKIADYWIEMKSALIGKENTVILNIANEWFGTWDGNGWAQGYKSVIPKLRNAGIKNTIMVDAAGWGQYPKSIFDYGTQVFDADPLKNTMFSIHMYEYAGGNAETVKSNIDNVLNKNLAVIIGEFGIKHTNGDVDEATIMSYAQQKGVGYLGWSWKGNGSGLEYLDMSNDWGGSSYTEQGRAIIEGPNGIRATSKLSTVYSSGKQ

SEQ ID NO: 2516 - protein, 265 aa, Paenibacillus sp.
MKRIFTLWLCVAVIGMLTVTAEPAWATQTVDGQPYHFGFKKSKGGELPSIAQEGFMQLIERQGGIFLGDTTKKELFLTFDNGYENGYTPKVLDVLKAKKVPAAFFVTGHFVKDQPDLMRRMASEGHIIGNHSWSHPDMSTISSTEIRSELDRVRNASAELTGQKEMKYVRPPRGIFSEKALASCREAGYTSVFWSVAYKDWDTNIQQGTDYAYRQVIGQLHPGAVILLHSVSKDNAEALGSIIDEARKQGYEFKSLDDLKVKHYH

SEQ ID NO: 2517 - protein, 497 aa, Paenibacillus sp.
MKKLPSVFLLSLLLLFSFNQNTYAASIGERLTSPEAGWKRFDDKDPNIIYKGAWRDGNGDIYYNLSRKVTNRSGDTATLSFFGDKIRIITDSATGHSNKLNIEIDDVLESFPLNKGAGSQYLTYEKINLDNTWHKVVITTTDSLFSTIDAIDISENGFLGNPTVIEKIKVTSGEASADLNWGQVELATSYKIKRSTTSKGPYTTISNNSTGLEFNDSNLANDTTYYYIVEAYDKSGKLIHTTKECSVTPPYSSMEGMGGISPPVGTTATASSDDKNAIKALDRDFDSRWNAVTPIASLELKFPKPLHLNFVQLAAQVTPQTQVDYTIFGLKDGEWTQISPITTRAIDVSTQMRVLDRINITEGVYSSIKITANARSSWASIHEITLGIVSAIPVTPDSPGSETPTPDQTPNPEPSQPTGDRAILSVTLDTGLEKEFDLSMKEVNSFIAWYEGKQSGSGAASYAINKHNNNKGPFSNRKDYVIFNKILTFEVSEYSTK

SEQ ID NO: 2518 - protein, 102 aa, Paenibacillus sp.
MPNQGGSSFTNQGFKASTGNQFKAEFAQDNTVGVVSQKVKQSEQNKIQDNFQTPNEKYDEEFATDQGGTGAVAQKVQNSSRNKIQNNAQTPNEKFDENFNTK

SEQ ID NO: 2519 - protein, 723 aa, Paenibacillus sp.
MKQLKTKQVLRKSMKYAFALSLVASSFLPGAGFTDKIHAESHVDNPYQGATKYISPDYAASVDTSIAKITDANLKAKMQTVKTFPTAVWLDRIAAINGGGGKLGLEAHLDQVLAQKKGSTPITAEFIVYDLPGRDCHALASNGELPLTQAGLETYKKDYIDKIAAIFANPKYKDIRIVAIIEPDSLPNLVTNLDDPKCAQAKSTGIYEAGVKYTMNKLNEIPNVYKYVDIGHSGWLGWDNNRSATVSLFTTIFKDTSKGLASVDGFITNTANTSPLTEPNLPDPNLNIGGQPIKSSKYYEWNPNFDESDFAEALHRDFVSAGWPSSLGMLIDTGRNGWGGPNRPTSAVGNDINSYVNSGRVDKRSHRGNWCNNSGAGMGTPPQTAPAGHIDAYVWAKPPGDSDGSSSLIPNDEGKGFDRMCDPTYTTKDGTLTDALPNAPISGAWFHDQFVMLVQNAYPAIVPSTGGVDPAPTAPAVPSGLKAVVGNAQVTLTWNASTGADSYTVKRATSEAGPFTAVAPLVTEREYTDKGLTNGTTYFYVVSATNAKGTSKDSAAVSAEPKGTPTDPTDPTDPTDPTEPAGDLVVMYRAGDTDPANNAVKPFFNLKNKGTTPVKLSELKIRYYFTKDGSQELQSAVDYAQVGNDNVLRTFTDNYIEIGFSPAAGTLAAGAQTGDIQIRMNNSDWSNLDESNDYSFDPTKTSYAEWNKATLFHNDKLVWGIEP

SEQ ID NO: 2520 - protein, 344 aa, Paenibacillus sp.
MKQRRRTWTRIVFLIISCLLLFVISGFVYEWIASKKDKSQYPPPGELVDAGGYRLHIRKLGNGSPTILLESGSGESSLSWRDIPEKLSSFATVVSYDRAGYAWSEEANTPRTGENIVRELHTALKNADIRPPYILVGHSLGGMYSRLYAQTYRDEVAGLVLVDARPENDARRTNKIYAKERPKANPSPLISILLEKSGAFRLFPNFMLTGRVEYQDRKSFVNIVASSKYFRSVAEEGDLASTTEDAIRGQHLGNLPVRVIARGIQQDLTQFGISKRGNDQIEQSWQMGQREMLNISTNSKLIVAKKSEHMIIHDQPKLVIQVIRELITDTSHFQSTTSKAFTDD

SEQ ID NO: 2521 - protein, 533 aa, Paenibacillus sp.
MTRNKRLRRLSTAMLTVPMLTMFASGAMAEQELNKHKPPVSTGSGVFYEIYINSFYDSNGDGHGDLKGITQKLDYLNDGKPHSGKDLQVSGLWLMPLNPSPSYHKYDVTDYYQVDPQYGSLNDFRTLMKEADRKGVKVIMDLVINHSSSEHPWFKEASANPQSKYHNYYVWADENTDLEEKGSWGQQVWHKNPNGEGYFYCTFWSGMPDLNFDNPEVRKEMIKVGKYWLQQGADGFRLDAAMHIFRGQTKDGADKNIAWWNEFRSEMEKVNPNVYLAGEVWDKPETIAPYFGPLHSLFNFDLGGTILNSVKNGRDQGIATFAEKTLQLYKSYNKAALDAPFLSNHDQTRVMSELGGDVRKAKLAASILLTLPGQPFLYYGEEIGMKGEKPDEYLREPMRWYKGDGPGQTTWEKPKYNTGEVSVEAQLRDDDSLLESYRTLIRLREEHEALRSDSLQPIQAGSASVTAFKRTSGKETMYVYHNLSGESVTLQIKDFDKGKWKVIFSTSKDVKVKKGTVTIPAYSSLITEEDRKS

SEQ ID NO: 2522 - protein, 82 aa, Paenibacillus sp.
MLKKMKIMVVVALMISSFGAAVAFAENSQNNMGTNDNGRTQMLTTNNNDDDNDNDNWGWLGLLGLVGLAGLKRREPENHKKR

SEQ ID NO: 2523 - protein, 573 aa, Paenibacillus sp.
MLKRRPVSLLSLTLAITLLLSTFASVAAAAESDGQAPQTAAASSMQSYVEAMQPGWNLGNSLDAVGADETAWGNPRITQALIQQISAQGYKSIRIPVTWDKHIGAAPNYTVESAYMNRVEEVVRWALDANLYVMINVHHDSWTWVSSMEPKHDEVLARYNALWTQIAQRFKEQPNKLMFESINEPRFSEGGTTDEAKMNQMLQELNVSFHKIVRASGGKNATRPLVLPGLDTSPAQAKINELYNTITKLNDPNLIATVHYYGYWPFSVNIAGHTTFDKDTKNDIIQTFDNVYNTFVAKGIPVIIGEYGLLGFDKNTGVIEQGEKLKFFEFLTYYMKEKKITGMLWDNGQHLNRTTYKWSDPELFNVIKSSLKGRSSNAASDLIHLKKGTPAQDAKVILNLNGNQLKTLSVGSKQLTQGTDYALSGDTLTLKASLLTSLTTSGKYGENAVITAKFNKGADWNFRVVVYDTPKLSAIKGTTQAFSIPTDFHGSQLATMEAVYTNGGNAGPQDWTPYKEFGNTFAPAYDANGIKLLPELFNSVKDGDVTLKFHFWSGDVVTYKITKSGTRVTGTTS

SEQ ID NO: 2524 - protein, 358 aa, Paenibacillus sp.
MSKKLSVLVLTMVLLLTVALVGCSKKLEPKEAVTTGTANAMKLNSYESKSQFTIKELTITSASVPSEQSAMVTSMLKNADITLDGVYQKEPFQSEMTLGIHLKGDLSTSFTIPMVMTKDKLYVKIPNIPFYPLPQDVVGKFLIIDPQELAKQSGQEFNPAAMDQEKSQKFANEVIAAIMNEYDQATYFFDIDPKDAKLPQGVEAKQVVQFKITNDNVKQATNTFITKALPKVLDVMSKDEYAGMLQVKKEELAEAKKELQSNTSEVSKKLDELKNYLTVKQFDINTALNKDNIPVYQDLNANVEMNDPATKDNVKLSVTGYTQYSKINAKAAFKVGIPTGDQVLTMEQLQQKMQTVAP

SEQ ID NO: 2525 - protein, 397 aa, Paenibacillus sp.
MKKKGMKKTFFVIASLVMGFTLYSYTPASADAASVKGYYHTQGNKIVDESGKEAAFNGLNWFGLETPNYTLHGLWSRSMDDMLDQMKKEGYNLIRLPYSNQLFDSSSRPDSIDYHKNPDLVGLTPIQIMDKLIEKAGQRGIQIILDRHRPSSGGQSELWYTSQYPESRWISDWKMLADRYKSNPTVIGADLHNEPHGQASWGTGNASTDWRLAAQRAGNAILSVNPNWLILVEGVDHNVQGNNSQYWWGGNLTGVANYPVVLDVPNRVVYSPHDYGPGVSSQPWFNDPAFPSNLPAIWDQTWGYISKQNIAPVLVGEFGGRNVDLSSSEGKWQNALVDYIGANNLYFTYWSLNPNSGDTGGLLLDDWTTWNRPKQDMLSRIMKPVVFVAEQAKATAE

SEQ ID NO: 2526 - protein, 280 aa, Paenibacillus sp.
MEVKLVVDFEAYENGQTMAKLLEELAAKPESAEVTDLIIGDWGGAYESSPDDFIPVLVKLKDHFPKLRKLFIGDMEYDECEVSWINQTNLSPLLEAFPALESFHIKGSQDLSLEPLRHNNLQELVIICGGLPVSVLQQIHNAELPELRKLELYLGVDNYGFDGNLKDVLPFLNSNPFPKLTYLGLKDSEIQDEIAIAAANAPVIGQLEVLDLSQGTLSDKGAEALLASESIKGLKHLDLSYHYMSSEMMQRWKSSGLSVNVEDQQEADEEDDWRYPSLTE

SEQ ID NO: 2527 - protein, 125 aa, Paenibacillus sp.
MKTSSFFLGIVLGAVASSLISRNRDMLGLSMDMGGKKSGNLVQKARTKMMDAAFPGMGEITLNKEDTHKDQDHHSPTDKTAHNAHTAKNKEENMKLIKDFIRTSPDVKREVEQILKETHTAVPGL

SEQ ID NO: 2528 - protein, 386 aa, Paenibacillus sp.
MNFYSRIKLLGLLLVFLMCSIGNAQHVQAALPPQASLDLFGSKSMRTTQESVVPDLKVYPGGQTIGVKVKSSGVLVVGHHIIQESNDRKVSPGETAGIRLGDRITHMNGKPLNSLARVAEAVDEAGKNKKPLDITLCRGEQTISTKLTPAYDQDDKAWRLGLYIRDSAAGVGTLTFYAPDQGVYGALGHVITDMNTQTPIVVGSGEIVQSNVTSIAKSQSGEPGEKRAHFLKDHRVLGNIERNTNFGIFGKMSDEPQYGLYSTPIPVALANEVKEGPAEILTVLEGQQIQRFQAEIVHISQQDKPATKGLVIRIVDPKLLDKTGGIVQGMSGSPIIQNGKLIGAVTHVFVNDPKSGYGCFIEWMLRDAGIMQNNVSLKSSSNLKAS

SEQ ID NO: 2529 - protein, 350 aa, Paenibacillus sp.
MKTGNRIMVFAMLILLSSLLYPLGSVGLGAASAAPAFAKGADISWVAGMEAQGMTWKDKKGVRRDILQILRDDYQINSVRIRVWVNPDMKDYASGYMNAEKAAELAQRAKKLGMSVMLTLHYSDSWADPGQQNKPYAWRNFTFTQLMDAVWSHTVYVMNTMKSKGVTPDWVQIGNETNNGMLWEDGKASVNMKNYAWLVNTGNNAVKSVSSSTKTIVHLANGDNGSVLNWNIGGLIDNGAQFDLIGLSLYPSPSDWQGKVDQTITNANNLIAKYGKGIVISEIGMEYNEPAASKAFISAIKTKVRNIGGGKGTGVFYWEPAATPGYNQGYNKGAWQADGKPTSALEGFIN

SEQ ID NO: 2530 - protein, 621 aa, Paenibacillus sp.
MNKRFRYAALLCLGVMLSGVVTPMDSQVSAASTRQMEKLNRGAVAVKVPEGVLVSWRLLGTEADSVGFNLYRGTSKVNDAPITSRTNFLDKAGTTSSSYTVRAVVNGAEQAASPAVKVWNNNYLDVPIQQPAGGTTPDNVNYTYHANDASVGDLDGDGEYEIVLKWDPSNAKDNSQSGYTGNVFLDGYELDGTRKWRIDLGRNIRAGAHYTQFLVYDFDGDGKAEIVCKTADGTVDGAGVKIGDASADHRNTSGYILKGPEFLTVFSGDTGKALSTIDYVPPRGTVSNWGDNYGNRVDRFLAGVAYLDGVRPSIVMARGYYTRTVLVAYDWRNGNLSRRWTFDSNSSTNAGTAGQGNHSLSVADVDGDDKDEIVYGSLVVDDNGAKLANTGMGHGDALHVGDLDPDRSGYEVFKVNEDKNATYGAAMYDPRNGNILWGVNTGKDTGRGMSADIDPRTKGNEQWAPGIGLRSAKGQLITNTLPSSINFGIWWDGDLLRELLDHTSSSAGKIDKWNYMNSTTSNLLTATGTSSNNGTKGTPSLQADLFGDWREEVIWRKSDNSALRIYTTPYESEHRFYTLMHDPVYRLSVAWQNVAYNQPPHTGFYLGEGMSKPQQPNIYTP

SEQ ID NO: 2531 - protein, 153 aa, Paenibacillus sp.
MTIAFIVVAAVAFIFLLVFNTKMTRKSSPKTRPAEEESRQRSKRPYPVQVEPEVRERIDSTREMPHKDIDVEEHHAEEQHKVPDIQTDKKVEKDRENIKDAYGDQDYRAALRGFARKDEEKDRRSQISNGEKETHKSEDEQYREALRSMNQKK

SEQ ID NO: 2532 - protein, 319 aa, Paenibacillus sp.
MANAAVYHVIISKGKLGNKSLAITASDKDDSVFISSHEYGNEYQLWEKRSVRSGDSSAYALVNKKTGKCIGRRSVANGSELYLEAASQADTSDIMVWKDDSVAGTYNAIKNYADWEQKINVPHSRFHEGQKLVTWEWSNAADNELWLFLAEKKNIKIKHMDFQLEGVSPQVDQPLVTDKQIVKNTTGIDQTQVLTLSYSKGVSYSFNTERSLKISETLEFKAGLPLLGETKVKIGVEGTRKYSETNATDDTEELTLEVPVTVPSGKTIEVSAIVMQGKLDVPYTAVFEISYPDVTVEETVSGIFSSVNSYSVYTEFKLL

SEQ ID NO: 2533 - protein, 515 aa, Paenibacillus sp.
MKNLANLPVMSQANALAQGMNIYGTRDTSSFIKLLVTPSKAPNKTVTFLGKDYQIPSYVNLLENTETYYDAGAYNSREEVQNSLGAHVGISGKYGAFSGEMEADYSQAYHKNSQFDYAYRNFYTQVATLQYQYDPQYLSSEFLSRLSDLPYESDTDNLDIFSEFFNDFGVFFTSKVVLGGTLQFYISVDKQSQTSTNEISAMVKAQYEALFSSGSLDANIKISDAWKRYSTNSNSTLKATGGDPEKISRIVMIDTFEPSKETVEAFHEWVSSIASDPAIIDFSLEGIWQICGDKRQAVQSAWEKYSDIMHPRMTIRTSSQVIEYPIEIEPVTPSIYIGSQSFKPNDTPASPAGFQVLILSGSNISEVIFNKYYAIPPVQYWYLPSLEVWDDFVKDVQGKHDSSNNILILVTFGLDLGMTPSSDAIDVLRSAGAGSGLVKWVKGCSPPSQAPTPSWVSYPAMYSLTGIFGNGPDTGVEYLKYSGWDGVYSDLSLDLSIYFYRQTFSGNYTFGLGEL

SEQ ID NO: 2534 - protein, 215 aa, Pantoea sp.
MKNLLLCPVLAALVLSGCSVGHTEYSRTAMQHVDMSVTGIPTILGLGTLGTSIPLTPEYSLTAAHVAKTAVQRVKSYHPYCDLAIIYHKNDASTLTKFRNSDIGDPVKMYGYSFISAMPVESTGVNLARTAIRNNWNKSPCIAMASNAGVVQGMSGGGVYNRDDTLGGVIVGYSDSIKNGRNNKVILKDVSLYIPYGQFKSWLESNLAQTPTRGA

SEQ ID NO: 2535 - protein, 88 aa, Pantoea sp.
MKMKLAIAALSLASLFSVGANAASLVSSEQAQGLQPMNQTISIGGRNGDQTHIRQVLSEKADAQGASHYRIIENNQDNTWHVTAELYK

SEQ ID NO: 2536 - protein, 87 aa, Pantoea sp.
MNIKTTIATVSLLSVMAFGASAAQLVTGDQTQNLQPAGTVTISGTAGSPMDYRAELSQKADEQGASAYKVIEARTGDNYHITAQLYK

SEQ ID NO: 2537 - protein, 251 aa, Pantoea sp.
MKIKKMVLALGLTTLLSGCQGLDNNALMQSGAQAYQAYTLSDDQVKQLSDKSCEQMDKDNQIAPANSDYQQRLNKIAAALGDNINGVPANYKVYQTKDVNAWAMANGCIRVYSGLMDMMTDNEVEGVLGHEMGHVALGHTRKAMQLAYATTAARTAAASVGGVIGSLSQSQLGEMGEKLVNAQFSQTQESQADDYSYDLMKKRNIDPMGLATSFEKLAKMEQGRQSSMFDSHPASEARAAHIRERIAADSK

SEQ ID NO: 2538 - protein, 68 aa, Pantoea sp.
MKTFVIATLLGLFLSPPALASNADCAQQIRSHSSEAASGYIYVNRLDAPQKSPVNAPARAAEKSSAHW

SEQ ID NO: 2539 - protein, 288 aa, Pantoea sp.
MRISLFSGTPTVIGHDNRGLTVRDILYNRHPGLPEATDERITRHRYDARGFLTQSADPRLHERGLANFSSVTDAAGRVLRARGADNGTIVMLNDAAGRAFMTVSNIRTTEDDTEDLSQAVTRNWQYEGAILPGRPVSMMEQVTGKTARITARFVYAGNAGEEKALNLAGSCVSHYDTAGLVQTDSIALTGVPLSVICRLPKDADNPDVMTDWQGDDASLWNDLLDSESQATLTTADATGAVLTTTDARGNLQRVAYDVAGLLSGSWLTVKGGREQVIVASLTYSAAGQ

SEQ ID NO: 2540 - protein, 119 aa, Pantoea sp.
MNYFRIDSLAGVLLLCGCQAPTPDQARQQQPVFQGQSTRTVPQLSDCIYRGWSTTSVIARDNTTHTQPDGSEISVFTWEDSIFADVSPRRKGSDVKYFTTFRMAPQVMADRQAIVERCL

SEQ ID NO: 2541 - protein, 132 aa, Pantoea sp.
MKLVHGLALAVFSLCISASALAEDTCAKQPSDGALFQCTVQQKKLAEDELNKEYQTAKKRIVQMYGTQKKLADDYVATLVDTQRSWLRYRDGQCKLEAFAAEEGSNANAVATNLCVIRIDKERTAILKQLPY

SEQ ID NO: 2542 - protein, 101 aa, Pantoea sp.
MSKDTSSEHLRAELKNLADTLEEVLSSSTEKSKGELDKLRNKARVALDSSRERLGESSERIAATTREAAQKAEGYVRENPWHGVGIGAAIGVALGMLISRR

SEQ ID NO: 2543 - protein, 189 aa, Pantoea sp.
MKLKLFLFAAAGLTVAIPSLTQAATTSGTINATLTLTTGCLVNGQSATAGVNFGTLNFGSSAATFDTLNATLVGAAGNGIFVRCTTGQDYNVVVTSSNAAPATIYGTASASPRYLVLGSDNAQGIAYTLYSDASFTTAIANNTPIAASGTTDPTLGTNYAIYGRVVGGGFNPLIPAGTYTDTINVAVNY

SEQ ID NO: 2544 - protein, 117 aa, Pantoea sp.
MWDVDTTKRFDEWFKAQTEELKEDMLAAIVILSEYGPHLARPFADTVDGSDFPNMKELRVQHQGKPIRAFFAFDPSRRGIVLCAGDKTGVKEKKFYKDMIKLADAEFRKYLNGGDNG

SEQ ID NO: 2545 - protein, 850 aa, Pantoea sp.
MQRCSGSTLGAGGNLAITATGAQPGSAGDILVQGSQLQAGGDLRLTAKNDISLLSAQNSERTDSTNSSKGGSLGIGLTAGSGGYGISVSASVNAGKGRENGNGLTHTETTLTAGNGLSLNAGRDTMLTGAQVRGDSVKVDTGRNLTLTSEQDSDRYDSKQQNASAGGSFTFGSMTGSASVNLSQDRMHSNWQSVAEQTGIFAGKGGFDVTAGEHTQLNGAVISSTATADKNRLDTGTLGFSNIENHADYKTEHQSVGMSPAGSTGSQFEGNMANGLLAGLNGSGSASSVTKAAVSDGTLIIRDKAKQTQDVSALSRDAAGANPGLDKIFDKEKEQRRMETAQLLAEIGSQAGDIARTYGQIEATKAATEKMKTVTPDQKKDAEAQWRKANPGQEPTAADITGQVYQTLYNREMLAGGMGTGGSVQQGISAATAAIQGLAGGNIAQAMSGAAAPYLAEQIHKLTTTKGPDGKEVVNVQANLIAHAVVGAVTSYASGNPALAGASGAAMGEYIAQQMYPGVKREDLSEEQRQTISALGTLAAGLAGGVAGDSTGGAVAGAQAGKNAVENNALHAPDEKKRQDAKWSLPYLEGEKKQQAEQLISDLDAKDKAFDVALDSACKGLSSAACQGMRQELAAMGKSYSEQLDGQYIGNMGSVYKEGKGQVDALIWQYATADAKAERDANVNRIAENWGVSKETADGLYTTMAGVHTAAAIGGALWGLKGPGTVTVYRVEGTPNTRVVIGDNGQVSITGNTTLYLNFGDKARALEFFEKRGSQNMDGAAIKTFEVPHSVLDDLRNTVVKESVARLPENKGKPVIADPTKAKDQYGIRPEKLEELKDKIIQGTGRNASK

SEQ ID NO: 2546 - protein, 413 aa, Pedobacter sp.
MVMIIKLKTMNKINLTSILLSALIFLSGCNKDVLVDLDIPQAGNYAQLYMPQATSNPIGMGISITDQDYQVPYAAHLGGSLAAQTDISVTFKVSPELVTQYNQKNNTTYQLLPEGSYALQTENAMIPKGAQGTGILKLVIKTKGFLQAFESYLLPVSVSAPSGVTLNKELSTTYFVITGSYAPGEVPREKVLSMGADAGDFLIDFNGDFIRKAPLTGDLILYKADAATGQFTAPPKTIGFGWNVMDKILSYGGNRLIARFGSGAGDINQYFLSQDGAFGAQRGVGQGWGGLSAIVPFKGLLLGIAANGDMTKFPLNGDGDFDYGNIKQIGTGWAGLAQIFSYQNSLITIENSGDMWQYPLTDDGVFGARKKIGTGWDMYTKVITAGTDLLALDANGDLWRYKFNPDGLWPLKK

SEQ ID NO: 2547 - protein, 199 aa, Pseudogulbenkiania sp.
MLYLRLMIRGFLLAVLLVVLGFAYVAWSIVDYGSGDDVPAADAALVLGAAAWGSKPSPVFRERINHAVKLYQSGKVRWIVFTGGTPEPGYPAEADVGREFAARQGVPMTAMLVENQSRTTWQNLSNARDLGNQFGIRSYLLVSDPLHMRRAVLMAGDLGLRAYPAPTLSSRFRTLASWSRFLARETWLYVGYRVFRQLS

SEQ ID NO: 2548 - protein, 245 aa, Pseudomonas sp.
MSKSIAVSQQSQQLHNDVQEAVKSIMGATQLKASDYGRVLRSALAASQKTVTIEIAAGDLTLLKKSNYKLCFAKKVGDADYNVVWQSYDAYLSNNEFSWTPQYQLFASNLFKANVQVKVSTNIVNIGLGQTSTLDEHGLLSSAVTGGPNISMTFVNDYAPIHPGINQLSTGIDGNQVSTPIYVAVDQVVTGETVLTPVETILVWFEQNVQTSTMFSTSRSKAIEIDLTFDNTAGRLYEGGQWKTV

SEQ ID NO: 2549 - protein, 167 aa, Pseudomonas sp.
MRWLLALFCLSFVTVSQASAVETLDGKVIEKILILKSSHQLQLINDGRPLKTYRISLGKRPKGPKLMEGDKRTPEGFYWVDWRKISDRFNLAMHISYPNISDSARARREGVEPGGMIMIHGTPDSEDTPEDLFHTLDWTDGCIAMRNMDMREVWNLVPDGTMIEIRP

SEQ ID NO: 2550 - protein, 173 aa, Pseudomonas sp.
METPYVKSLLAVLSLIALPVMAAEPTLYGRYEYIALPEVGGQVLKAKMDTGALTASLSAKDIETFTRDGEEWVRFRLATKNASNKVYEHKIARISKIKTRSEEDEEDSEVIAPTKRPVVDLELCLGNVKRTVEVNLTDRSSFNYPLLIGAKALREFGAAVNPARRFTADKPDC

SEQ ID NO: 2551 - protein, 474 aa, Pseudomonas sp.
MSIPRLKSYFSIIATVLVLGQAVTAQAVELPDFTQLVEQASPAVVNISTTQKLPDRKVNQQMPDLEGLPPMLREFFERGMPPQSRSPRDRQREATSLGSGFIISSDGYILTNNHVIADADEILVRLADRSEMKAKLVGTDPRSDVALLKIEGKDLPVLKLGKSQDLKAGQWVVAIGSPFGFDHTVTQGIVSAVGRSLPNENYVPFIQTDVPINPGNSGGPLFNLNGEVVGINSQIYTRSGGFMGVSFAIPIDVAMDVSNQLKSGGKVSRGWLGVVIQEVSKDLAESFGLEKPAGALVAQIQDDGPAAKGGLQVGDVILSMNGQPIVMSADLPHLVGALKAGAKADLEVIRDGKRKNVELTVGAIPEEGKEMGAEPKSSVERSSNRLGVSVVELTDEQKKTYDLKGGVVIKEVQDGPAALIGLQPGDVITHLNNQAIGSTKEFADIAKALPKNRSVSMRVLRQGRASFITFKLAE

SEQ ID NO: 2552 - protein, 369 aa, Pseudomonas sp.
MDANDNAFILDKRGVLKERSFRDSSRAGSIWMPPFFVQEIMQSSSNLFPVALISAERRGDLSEDVYRLKPGNSPDFTVELAVTRLGMADESSSRGVPVILLHGSFSNRRFWFSPKGLGLGAYLARQGFDVWIPEMRGHGLSQRNHDYRKNRVADYARYDLPAIGAFVREQSGQVPHWIGHSLGGTTLAAALGGEYIGEPVVASAAFFGTQVSRTYWPLKIPPVEWSGRFILKRFAQLSGSRLKRGPEDEPIGLALESMRWFGLFGRFGDADKDWWAGLAEVKLPVLAVSAAGDHQDPAWACRKLFEQFGSEHKQFINLGREQGFGDNFGHVEMLVSKAAQAEVWPLVTRWLADQQTPLPGAQQDLVVAV

SEQ ID NO: 2553 - protein, 341 aa, Pseudomonas sp.
MRKSLLALLFVGWVGFGQAQVPLREGYPQRYTVVAGDTLWSIANRFLRDPWQWPALWQANSSLADPDLIYPGDSLALVQVNGEPRLTLERGASRGTVKLSPQVRRTPLAEAIPTIPLQAIDSFLLSNRILDRAETFDSAPYIVAGDAERVLSGTGDRIFARGRFDPEQSAYGIFRQGKTYTDPQSGELLGINADEIGGGEVVAVEGDIATLQLQRTTQEVRLGDRLFSGEPRVINSTFVPSPPSRAVEGLIIDVPRGVTQIGALDVVTLNKGRRDGLAEGNVLAVLKTGETVRDRVAGGQVKMPDEGAGLLMVFRTYDKLSYGLVLNASRSLAIMDKVRNP

SEQ ID NO: 2554 - protein, 80 aa, Pseudomonas sp.
MNSALLLSNAIAIAVLVVFHFQPDGSADQSNQYRAHYVQHQAPQWAVMSSTSENPGMAQVADAPEAVVLPANPRPESWVF

SEQ ID NO: 2555 - protein, 359 aa, Pseudomonas sp.
MANEVFANNMEISCKAADGKSVAAFPDVCFTPPQAPPTPTGVPIPYPNTGMAKDTTRGSRTVKITRKEVMLKNKSYFKTSYGDEAGCAPKKGVITSKIKGKVYFTSWSMDVKFEGENVVRNLDMTTHNHASQPGNSPTWPYIDTAAAANSSHPCHNVVKGLKDNNCQRHVDANTYSTDAINRAGASEALCGDPKCKKAMECVLTPYEPSNCCDGKTPHHIVPKSQFKERGKGGKALLLDAQGANKYDPNKAPCICEDGHSHSTGTHGDIHEETNLLTVNHPTVKPKVTGKTIAPDARWSVAEAEAVGAEAAQKGGSKCDKECTKSQVRESHQKMNIGPTDQIRPSTAGRVPEPSNPTTF

SEQ ID NO: 2556 - protein, 414 aa, Pseudomonas sp.
MTQTSPRSLLAARIGLTLALGLLATHASAEPHPQVQNDAQQYQGDALKLLERLVNIDSGSGYEAGLNQVSDIAIAELKKLGASIEKVPNGAAGGNHVLATLKGTGKARILLMAHMDTVFKEGTAAERPFRIQDGRAYGPGVMDDKGGIVAGIYALKVLDNLKFKDYAQITFLLDASEETGSEIATDLIKKTAKAHDVTLNLEPGRPADGLVVWRKGSATALVEVKGKAAHAGVAPELGRNAAMEAAHQILQLGKLGDEAKKTTINFTVLKAGDRTNVIPDQATAKADVRAAVPEEFDRIEKDLARVSANKLIADTEVKTTLQRGLPPMPQTEQSDALVAMAQGIYGELGRKLTIEGSGGAADSSLSAGVGTPTLDGFGIVGGNIHTPEEYAEVESVAPRIYLLARMIMELSAKH

SEQ ID NO: 2557 - protein, 131 aa, Pseudomonas sp.
MTESRRPYGAPQPEPIDDNEDRMGSMEELDFDEEEPGARVGDPASSSVEHRTPHRHIHGSSLTGNAEDEPNDDDLTPENLIREDGARSAHEAGEDQPADWDLSIVDEDDIGGGNGLDEAELAQRDPLDGKP

SEQ ID NO: 2558 - protein, 709 aa, Pseudomonas sp.
MASASERSAVKKGKVAATAKKAEKKTTKKTAAVKAGKKVASRKTATAPVRVLNVRPDGLDFRDTMYIPTLVEVPVRRELSDYRETRVPVLDQGQENACTGYGLATVAHYLLRTRRYQSDATLVSPHMLYDLARRYDEWAGEADEGSSCRGAMKGWYKHGVCPAPQWQAGNQATTLTQVLAEEAALRPLGAYFRVNHTDIVAMHAAIAEVGVLYASASVHEGWHVVGGDGHIQPSANILGGHAFAIVAYDQDGFWIQNSWGETWGYEGFAHLRYDDWLANGADAWVARLGAPITLRVPLQASSQAKAVAAASSSETLREIRPHVISLGNDGAFDPRGDLATTAASVEEIFAVDFPRITAGWAKKRIVVYAHGGLVAQAGAIETVAGYRAAMLQAECYPLAFIWKTDYWSTLGNMLADAARRRRSEGVLDATKDFMLDRLDDALEPIARLLTGKAEWDEMKENGLRATVSANGGARVVAKALARLAAQGVEIHFVGHSAGSILLAPMVQYLVSRGAMNSGPMARSQLKGLEVKIASCHLWAPACTVKLFRETYLAPIRDKRIEKFGLFTLTDQAERDDHCAHIYNKSLLYLVSDAFEDKVRIPLIRPDGEPILGMERFVTGESDLAQLFASASNADWVRAPNDLPMGNQNASGARHHGDFDNDETTVRATLARILGQGGARHALVLSQPIAERAQRRRQVDLASSIGRRQP

SEQ ID NO: 2559 - protein, 105 aa, Pseudomonas sp.
MRRLLLVSSLLLCLPAGSAMARVDAGDVATSAGVSASLYSTFKDDKMVIPARDDASSFVASGGAIRGVYLESVLQKIRQENPGLNASDEELARAILTQQAQPAGH

SEQ ID NO: 2560 - protein, 89 aa, Pseudomonas sp.
MIKNTLAAVIATATLLSAGAALADRPGAGWVTIEKAIETAKTKAGYIEIYKIEADNNGYWEGEGRKSDGVVYEFRIDGASGNVVRDQKD

SEQ ID NO: 2561 - protein, 121 aa, Pseudomonas sp.
MNNLLRGLAAFALMSWASTAAFAAPQAHADSSPAPAMLLAQSLPGSSNNNPYNSPIRRANPNSMQGTQPSAPAVRGVNPVPVQRPPTLENGGIGNGYPRTITQPRIIDPTPVTPPRNQQQR

SEQ ID NO: 2562 - protein, 644 aa, Pseudomonas sp.
MLKAGLYTLLALLSLAPGAHANSMQWSSIRDGSLYLRTAQPDRLKIGWSPAWQSDANREQLYLLQPDGQLFKQLEIRADQAYGEQDIELPAAAGDYRLQIPGYSFRGFTVSHRGSTAAQFEPTKVHFSAEVHSGAELYFRVAAGEQAILAGKYYGGVSVLQASRLSDGAKVRLELKEHPAYGQFDQVALPPAEQDEVWRLSLGGSGKAAFWLDGTANLFAQEVQQLHSLDQPRGEAHLQLKAQILGTTPRLGIALPYAQPPQSTFGLLQAIGARAANFYSFVDVIEQEPEREIGFRRLYRERFGIDRDITLLAGTGRRAVLAADAQSFAGLDAWLADSVRLAGNGLHYLAFADEPNLNYPDYSSYALYFEQMLARAKANPEARAAGVRIAMPASSRLLDGPFRIGAGQRRGIDWARQLLERHGEDIDALAWHEWMVRDLLATRRYRDSVRAAAELVGLDAAGRPRKALLLSQTNISSGRDLSPYQQDTHYAGLWWASVVINASADGLLDMLNWFQAADEPDYPKGMLAQRSASQFSLKPVAVAQQFIARHWLAHVQALDNPAFEVDALAMSEAGRHSLLGVNKASRVQAVSLDGPGDLCQAAPLKLSLLGPDDQPRDATVECRDGRVHFELPGETLFALTWKAL

SEQ ID NO: 2563 - protein, 433 aa, Pseudomonas sp.
MVDMRKGALISGDSASYSDLNRLNQLKVGDKNSEGNLRKVAQEFESLFLGEMLKSMRSATEALGKDNPMNTPEAKQYQEMYDQQLAVSMSREGGGIGLADVLLRQMSKNKPLASGEAATLSAAKQQEALDKAKAPVPTPVAAGTLPDGPLSRSNGQRPLWASRAVSAPQGAEGIHRNDMELINQRRLALPPKLADRLLAGLVPSASVKPEAVAQNVLPDRAVAAVKPATGELANGDWLAALKAAEPKGDMQVYGRAVAQPPLAPARKAFRDADEFVNAMLPMAKEAADRIGVDPRYLVAQAALETGWGKSVMRQPDGSSSHNLFGIKASKNWTGDSARAITSEFRNGEMVKETAEFRSYASYRDSFHDLVNLLQSNSRYQDVLKSADNPEQFVRELQKAGYATDPNYANKISNIARQMTSYQNYASAGATTTL

SEQ ID NO: 2564 - protein, 218 aa, Pseudomonas sp.
MIDVTVWSVTLPVQTPAQVVATKAMPSLNNKYFDNNGQRIIFWAPVTGSHTGNSDYPRSELRETSRDGKHRNWRYNSGINTLKGELTVNQVPSEGRVVVAQIHAKNAPTPLLKLVYRFEKGTGNIDVEYRVKPKDKKSPVIYTVPKVPLNKSFSYTLQMDKQGQLSVLIGKNGKQVKLDKSWHGYDFYFKAGVYTLDNKGYSNEGGKVTYTKLSVSHK

SEQ ID NO: 2565 - protein, 1679 aa, Pseudomonas sp.
MPEPILRPVMPVARDLHLDLLKARVPGWYSAAIVQRQRELSDHTLELPDWYAKAPYETRASLKSSHSRYREILNQVDNVLGDIQDIRAFAEPLLEQAIKAEFKQTLDVNQVYFVRKYGRQVRGDFFGALVLDKGDSQFNQYEYHGSSLLEAALANFEPDEENRPGCADCTLITTQRPFYGGEVMPSTSAFRAGALPIAPQAFARLCRTLDLGRLYQEHINAIVRPPNEASRNQLDRQLRDHHRQGLALSMEIARAKGDISQAAFRMLQQVVGDQDAITLDDRAVTFTSLKVFDIELVGPLLIGPERENSRRVERLVAYLPGDPEQPLKEFASSADFMAQTRRRLRGIGYRRFFSRFVPLRKQGVFFEQFNRLYQPSEQENSLVDYPLKSNLRRLPMDTSPIPAPLWESLRLRQVQKIQLDARAVAVPTGDEDKKARLARQESYLNAVIDVLNLGAFVVPGLGPLMLTVGAVQMFNEAFEGIEAFERGETREMWAHFSSVALNTAFVATGAAVLPHIQWSNTVEQLEPLRLNNGEARLWRPDLAPYRSDLVPSAGAVPDARGLHRVNGRPILALDGRHYEVQLEPATQRYRIRHPSRPEAYQPKLTDNGSGAWRHELEHPHGWAGAKLMKRLGHRVEHFSTAELEQIRIASGTGEDVLRRMHIEGAPMPALLADTTTRFDICRQIETLTAQLQSEEALDYDKAEPMTQLHLLTRYGPWPKGLQLEVVDRSGRRLWHYAPDPQAGAAARGVSLAEANVRTPSVLKNLIEAVDAAGGDLLADASPAIAKTDMPARVRQLRKQLAEIVVREKVSLFNDYYAKQDLSSDPRATLIKSRFPSVPAAAIDQMLALATSAETQQMDAWDFADAAQTKPIPLRIAEELRHFQRTVRMNRAYEGLYQEPLATADTPRLALATLETLSGWSDTVRIELRADDLTGDLIGAIGPQGAQQTKYVIKDGGAYKSLDDQGNDLSHWGSLYDALQRALPDAERQAMGRPSIHQGDLLKQAIGAAPASRDSLASLLKLPPVMPSYKSPMRLASGQVGYPLGGLRERLGLSRSPQSRVLELYPDYTEQEVQALLEAFGDGAVGELKRRKVELQMLDRDLDLWANTPGWREVGRQRHQLVEPQARRAVAERIKRCWRRQVPVVTAVDGSRVGYELVLSQQYVGELPDLTANFSHVASLKLNDMGLTREGSESFLTGFSSLRWLDMTLNRLTDVPAALGAMNGLTRLQLGSNQIRLTSRSVGTLQDLTQLKILNLENNPLDRLPDFSHFPALRGLYLKSTDISVWPRGLGELPLERVDLRDNRLTEVPDDLIDPPPARALITARLNGVTLLQGNPLSELTQQRLGEYWANISLTHPQWMALRSPGAFGHALPGRPSNVQQWLRNLPSNELEARKDLWRSLAREPQSKELFRLLNRLAGSYQGEENYPDLQARVWQMLEAARDSTQLRRELFELAGAPACEDRAALSFSYLEIRLMIHNARALAGGTDEAAVLVRLAKGLFRLDEVERIALQDIQQRRDAINARRDLTAAQKAQHLQQIEEVEVRLAYRVGLKGRLELPKQPAGGRFLMLAGVTQEALDAAAEQVLALDDSPEQFQSLVGRDFWIDYLKEHHPTSFQALTDTLIANQIELDEAKAAGTLEAADYASQSEALALQFKVKEAELIQSLTQSELDALPESTEL

SEQ ID NO: 2566 - protein, 182 aa, Pseudomonas sp.
MNKSMLVGAVLGAVAVTAGGAVATYKLVNSGPEYAQVLAVQPVKQQIKTPREVCKDVTVTRQAPVKDQHQIAGTVVGALAGGLLGNQIGGGTGKKIATVAGAVGGGYAGNKVQEGMQERDTYTTTQTRCNTVNDISEKVVGYDVKYELNGKQGQVRMDRDPGSQIPVNKEGQLILGQNQPAQ

SEQ ID NO: 2567 - protein, 68 aa, Pseudomonas sp.
MKIDPLISTTLARLEPNQVGVLAWSLLAHPSVAGGIPGQPDPDTPQPAEPTEPGEPTLPDEPPPAPVA

SEQ ID NO: 2568 - protein, 73 aa, Pseudomonas sp.
MKASTLLLAGLMIASSGAAFAEGGAERMKHYWDNFPISQQIPRTDSEQTSSESGKKPQAPVEDPSRTPAQPDA

SEQ ID NO: 2569 - protein, 95 aa, Pseudomonas sp.
MRTLNRLLLASLIAIAPMAVIAAEDAPSADPEVTIRTEGDKTIQEYRQNGFLYAIKVTPKVGKPYFLVRADGSDGNFIRSDQPDMLIPAWKIFEW

SEQ ID NO: 2570 - protein, 497 aa, Pseudomonas sp.
MFPSTRVSAMRKLPLAITLGLVSLATQQAFAHGYVESPKSRAFMCSATGGNLNRDCGPVTYEPQSVEYSPSVQHHYPKDYCSGDFTKCGPANGTIPAGGITSFSQLNEQTATRWQKTTIKPGMNEFTWHYSAGHASAYYQFYITKKDWNPNQPLTRDSFEMTPLLNENAGGVRPPAGGKTKHKVNIPADRSGYHVILATWKIADTAATFYQAIDVNIDNDGAPIPDWKTLGAVQPEQLRVGDKVSTRVFTNAGEQQNRQTRLSIETAEQAQANTWPFLLAQQVNKANAGYVMGELNANNEVVPNYGKNTIYAKNNSDVVRVEIQKEQPSIPGELKLSGLQAEYSLKDSATDLHFNAIAQGGKYTIASTVFNGKGESIAHQQAEAGNNTPHFSIPLRNVSEGEYDVVVVAKPEKGEQLQQSQRITLKAEEVGGGGDYDFVFPKGLTGYKAGTKVLAKDGNVYECKPFPYSGYCIQWNAGATQFEPGVGSNWKDAWIRK

SEQ ID NO: 2571 - protein, 116 aa, Pseudoxanthomonas sp.
MRKNATVLAATFAALLFSGAAMAGDNDPQKKKAADADSSQPVSDTWITTKVKSSLLADSDVSGTKIEVDTVDGVVYLTGTVGSQAQADEAKRIAGEIDGVAKVDTSRLKVDAQASR

SEQ ID NO: 2572 - protein, 227 aa, Rhodococcus sp.
MSIESQNGISHRRSRAAVGLAACAVATLSSGVVFAGSASATPTALADKFASTVTDDGWTLDLAATKLSANPVPNLATTAFTREGFVSAKVTGTIGGQGDSAVKTGYVEQGLQIGCQIDVSSGLGLGLGFSLGPSVGVSISGVPSANVGVNASVNPSIQSTIAPGTITTIPLGKKDLESSKASITAENVHVKVDACMGPVTIRSYAQLSVSTATSDNTLFVYSDPTWL

SEQ ID NO: 2573 - protein, 230 aa, Salinibacillus sp.
MKQIIAMGGGGFSMEPDHLVLDQFIINQSKQPSPRICFLPTASGDAENYVQRFYHAFQKLDCDPSHLSLFKPPTTDLASFIMEKDVIYVGGGNTRNLLVLWKEWGLDHILKKAWENGIILAGLSAGAICWFEEGVTDSAGPLTGLKSLGFLQGSFCPHYDGEKDRRPAYHHMISAKALSSGYAADDGAALHFIDDQFFQAVSSRSDANAYQVVLHENEISEIALPITYLS

SEQ ID NO: 2574 - protein, 484 aa, Salinibacillus sp.
MKKKLAAGLTASAIVSTTLAITPAEAATIKVKSGDSLWKLAQNYNTSVAAITSANHLSTTVLSIGQTLTIPGSNSGTSSSSSGSTAKKSGNSVYTVKSGDSLWLIANEFKMSVQELKKLNGLSSDMIRAGQKLKVSGKVSSNSSSGTSSSSKSSKSSKSSSSSSASTGTYKVQLGDSLWKIANKVNMSIAELKVLNNLKSDTIYVNQVLKTKSAGSNSSSKNNSSKSNQSASATTKYTVKSGDSLWKIANKYNLTVQQIRNSNNLKSDVLYVGQVLKLTGKSSSSTSTTPSSSNSSSGTTTTTYTVKSGDSLWVIAQKFNVTAQQIREKNNLKNDVLQIGQKLTITGKASSSNSSSGSSGSTISTSAKINKMIAAAKDHLGVPYRWGGTTPAGFDCSGFIYYALNKVTSVSRLTAAGYWNTMKPVSQPAVGDFVFFSTYKAGPSHVGIYLGNGEFINANDSGVVISNMNNSYWKQRYLGAKRYF

SEQ ID NO: 2575 - protein, 642 aa, Salinibacillus sp.
MKPVISLILSTVLFLSCFLGVSQTAEAKPRSSDDAKQIVDRMTLDEKIGQMLMPDFRNWKKEGESSPQAFTKMNEEVAGLIKKYQFGGVILFAENVKTTEQTVRLTDAYQKASPKIPLLLSIDQEGGIVTRLGEGTNFPGNMALGATRSRINAYQTGSMIGKELSVLGINTDFSPVLDINNNPDNPVIGVRSFSSDRELTARLGLYSMKGLQRQNIASALKHFPGHGDTDVDSHYGLPLVSHNQERLREVELYPFQKAIDAGADMVMTAHVQFPAFDDTTYKSKLDGSDIMVPATLSKKVMTGLLREEMGFGGVIVTDALNMKAIADHFGQEEAVVMAIKAGVDIALMPASVTSLKDEQKLASVIDSLKEAVKNGDIPLQQINKSVERIISLKIKRGIYSAQHDSSIDKKVKKALKTVGSKHHTKTEQKIAEKAVTVLKNDQHTLPFKPKKGSRILIAAPYEEQTASIEKTIHDLMQRKKIKSVSLNKMNFAEKVFNAEHEKQVKEADYIITGSYVVKNDPVVNDGVIDDTVTDSSKWATAFPRAVMNAALQHKKQFVLMSLRNPYDAANFEEARALIAVYGFKGYANGRYLQPNIPAGVKAIFGQSKPKGTLPVDIPSVTKPGDILYPFGYGVNIKTGKPL

SEQ ID NO: 2576 - protein, 362 aa, Salinibacillus sp.
MLKKPIICLFILFLFASAVLAEPIQAHTVSPVNPKAQQTTKDVMNWLAHLPNRSENRVLSGAFGGYSHDTFSMAEAERIRSSAGQSPAIYGCDYARGWLETSNIEDSIDVSCNSDLISYWKSGGIPQISLHLANPAYQSGHYKTPITNDQYKKLLDSSTTEGKRLNAMLSKIADGLQELENQGVPVLFRPLHEMNGEWFWWGLTSYNQKDDERIYLYKQLYIKIYHYMTGERGLDHLLWVYSPDANRDFKTDFYPGASYVDIVGLDAYFQDPYSISGYDQLTALNKPFAFTEVGPQTANGNFDYSLFMSAIKQKYPKTTYFLAWNDEWSPAVNKGASSLYNDNWTLNKGEVWNGNTLTPIVE

SEQ ID NO: 2577 - protein, 209 aa, Salinibacillus sp.
MTTKFTALAVFLLCFMPASKIEHTQASLLNTKKTKHEEAKLLTHINHDTDTSFSSLSADEDKKKIKPIRLSANTEKKENEQSEKTNEKKETYSESEKELLSRLVHAEAKGESYEGKVAVASVVLNRTDKNGFPDTIRGVIYQKNAFEPVANGSINQEPDKESIEAVEEAMSSKDRETEALFFYNPKTASDDWIRSRKIIEKIGRHVFAI

SEQ ID NO: 2578 - protein, 335 aa, Salinibacillus sp.
MNAKRWIALVIALGIFGVSIIVSISMSFFESVKGAQTDLTSLTDESQEVTLENGSLSSKIAVLEVSGTIQDNGDSSSLLGSDGYNHRTFLKNLEQAKEDDAVKGIVLKVNSPGGGVYESAEIHKKLEEVKKETKKPIYVSMGSMAASGGYYISTAADKIFATPETLTGSLGVIMESVNYSKLADKLGISFETIKSGAHKDIMSPSREMTKEEKNIMQSMVDNSYEGFVDVISEGRGISKAEVKKIADGRVYDGRQAKKLNLVDELGFYDDTIAAMKKDHKNLKNASVVSYEESFGLGSLFTMGANKMFKSEIDFLNMREVLSQSGSPRMMYLYAK

SEQ ID NO: 2579 - protein, 540 aa, Salinibacillus sp.
MRTLFKTSLFMAGLCMAAQCVFASNASADQSIKYDHTYQTPSYIIEKSQPSWQPAQNLTQKEALFSYLDKQQTHFKLKGNANSHFRISKTIKDSKTKQTFFKLEEVYKGIPVYGFGQAVAMKENKQVKSFFGKVHPQINDISVTPSVSKKKAIHTARRALEASIGKIEYVDGEPKAELYIYPHEGAYDLAYLVRLSTSEPEPGYWHYFINAKSGKVIDSFNAIHEAAGTGIGVSGEEKSFEVTEQNGRYYLADETRGKGINTFDAKNLNETLFTLLSQLIGYTGSEVVSGTSVFHDPAAVDAHANAQTVYDYYSRTFGRHSFDQNGARITSTVHVGTQWNNAAWNGVQMVYGDGDGARFKPLSGSLDIVAHEMTHAVTQYSAGLLYQGEPGALNESVSDIMAAMTDRDDWEIGEDVYTPDVRGDALRSLEDPSKQGNPDHYSNRYTGTEDYGGVHINSSIHNKAAYLLAEGGVHHDVRVEGIGREACEQIYYRALTYYVTPSSDFSMMKQAAIEAANDLYGEDSKQSASVEKAYDAVGIQ

SEQ ID NO: 2580 - protein, 382 aa, Salinibacillus sp.
MRIFKKAVLIVIISFLFANVNVNTAHAAINVSAKSAIVIDGTSGRVLFAKGEHEKRRIASITKIMTAVLAIESGKMEETVTVSANAVRTEGSAIYLTEGQKVKLKDLVYGLMLRSGNDAAVAIAEYVGGSLDGFVYMMNQKAEQIGMENTRFQNPHGLDDHENHYSTAYDMAVLTKYAMKLKDYQTISGTKIYKAETMESVWKNKNKLLTMLYPYSTGGKTGYTKLAKRTLVSTASKDGVNLIAVTINDPDDWDDHMNMFNYVFDHYQTYLIAKKGDIPKLKGTFYESKAFIKRDITYLLTEEEKEDVKINTTLLKPKKAWEKDVSKIPDIVGHMKVMFNDETIAKVPIYYENERNQKPKKKFFETFQSIFLNAAGGAKWSI

SEQ ID NO: 2581 - protein, 326 aa, Salinibacillus sp.
MKVVLSALLLLLFAFEPYASGKELSDPVLSKRMELYHKVEAVTQIPWYALAAVDQYEENVRSNRKDLPDKTGIISIYVPDEIWSGPENPNPKDDAPLSIKVFDGIGMDGDGDGKAEVSNDEDILYTFAQYLLSYGTDEENIRIGLWNYYRRDQTVGIISEFMKLFKAYGHIDLGEHAFPLPIRTDYSYRSTWGDARGFGGRRIHEGTDLFAHYGLPVKSTCYGVIEMKGWNRFGGWRIGIRDINNTYHYFAHLNGFAKGIKTGQIVEPGQVIGSVGSSGYGPPGTAGKFPPHLHYGMYKDNGKTEWSFDPYPHLRAWERYEYKKKK

SEQ ID NO: 2582 - protein, 880 aa, Salinibacillus sp.
MKKRLIAPMLLSAASLAFFTITGSAQAAAYTDYSIYKVEPAKTFSTESQASQAAAKLEKDTGWDASYQASGTTATYQITATGIHSEAQAKTVLSGLTKQTAITGTSSPVGSKQPYMTITSGAISSEKQANTLLAKLKQETGVSGAVKMSGTAQFYMNVVTSEIAEETKVKELIQGLTKKTGIKSTYQPVTHEVSVTSIQSGAITGDSKAAQVKNAFQKESGLKASLKETAKGQAYYTFTTASISGEANAKTLLQQLKQSTGITGSYKSINQKTTADVYNVQSAYFKGLNTVKDAISQIKKNTGVSGYYQKVGKSTSYTVNMKNLTKQQLQKVDAFFKKKKWHYTSSAVKKTATSSAYQITTAQILGEQQANKAAAFFTQKKVKATKKATGKKAENQYQLISEETTDQAKVTKGLNVLKKNKLSAAAKTVKKQTANTFKITTESLLEAAKVNEAITFFKSNQISAASKKTGQTAESKYQITTEAIISQEDIDRVLAFFKKNNASGTAVKTGATAYTQYKILTSQLSSKTALNNGLNYFKALQLSANYTTKSNTLYKISLNEQFTGNSAASAASAKLKQLYGWTSSTVKIKNGPQIMKTNYNLSLRDMVQKQMKVSPQTDGAAYVSLTYINTATSTVTADVLNIRSTPAVSPTNVIGQLKKGDKVKIIGQTNGWAKINMGWRNASSDEVGQYVDPNNFSKDSKYYFQFLKLSQTAGLSVAEVNQKVLAGKGILTGKAKAFIDAATKYSINELYLISHALLETGNGTSDLANGLTYNGRTVYNMYGIGAYDSNPNYYGAKYAYEQGWFTPEAAIIGGAKFIGSSYIHNTAYNQDTLYKMRWSATAAHQYATDIGWAYKQVNRMYSLYSLLDGYTLYYDVPEYQ

SEQ ID NO: 2583 - protein, 250 aa, Serratia sp.
MKIRTSLIALSITALLSGCQNLNTDTLLQSGAQAYQAATLSDSDVKALSDKSCAEMDSKEQIAPASSDYTKRLNKIAAALGDNINGTPANYKVYVTKDVNAWAMANGCIRVYSGLMDMMDDNEVEGVLGHEMGHVALGHTRKAMQVAYGTVALRTAASSAGGVAASLSQSQLADLGEKLVNAQFSQKQESEADDYSFDLLKKRGINPEGLATSFDKLAKLDGGHESSMFDSHPTSEARAKHIRDRIAAGK

SEQ ID NO: 2584 - protein, 887 aa, Serratia sp.
MNKFKMSALAALTATVGLLGSVGSAMANQQVVDQLSQLQVNLKMLDNRAAENGVDCAKLGADWASCHKVLITLTNGNQEIKDKDWAIYFHSPRQTLKVDNDQFKITHITGDLYKLEPTDKFTSFPANQAVEIPIIAEYWQLFRTDFLPRWYATSGDAQPKILSNTDTEDVNQFVAPFTGDQWKRTKDDNNILMVPESRFTKNQDLKVLPMASLRGQIIPTPMEVKVHAKDIDLSKGVALELSALTKPAADAAAERFALLGIESQANGYPIKTDIKPAAFKGDQAVPGAYQLKIGEKGAEIVGFDQTGVFYGLQSILSLIPSDGSKKIATLDAKDAPRFQYRGIFLDVARNFHQKDAVLRLLDQMAAYKLNKFHFHLTDDEGWRIEIPGLPELTEVGGQRCHDLSETTCLMPQYGSGPAPHGGFFSRQDYIDIVKYAQARQIEVIPEIDMPAHARAAITSMEARYKKLLAEGKEKEANEFRLVDPTDTSNTTSVQYFNRQSYLNPCLDSSKNFVDKVIGEVAQMHKEAGQPLKTWHFGGDEAKNIRLGAGYTDVKNPEAGKGILDLSKEDKPWAKSQVCQAIIKDGKVEDMEHLPSYFGLEVSQLVKAHGIDRMQAWQDGLKDAKDSKAFATKHVAVNFWDTLYWGGFDSANDWANKGYDVVISNPDYVYMDFPYEVSPDEHGYYWGTRFSDEQKIFSFAPNNLPQNAETSVDRDGNHFTAKSDKPWPGAYGLSAQLWSEVVRTDQQMEYMIYPRAVSLAERAWHRASWEQDYKAGREYKGGETHQVDTKTLDQDWLRFANLIGQRELAKMDKAGVSYRLPVPGARIIGGKLEANIALPGLGIEYSTDGGKQWQRYDDKARPSVAGDVQIRAISPDGKRFSRAEPVKA

SEQ ID NO: 2585 - protein, 122 aa, Stenotrophomonas sp.
MQGHEPAAAVPKGPSLNDASHPDHALHNAGRSKLPSVFSEEAAANITLHAKQNGIDAADKLQSIKVQDGKPFVMGTTPGFRTAVDLAQAPPSLEQTSAKLLADPSHQQQVHEEQQRVAMGGR

SEQ ID NO: 2586 - protein, 456 aa, Stenotrophomonas sp.
MCRSMLWAMLLVVAPLAATAAAPEAHACEDDASPALRGSQCALMDVPLRHADPSGEHISLFLRRIPASADTTRRGEVWLLSGGPGESGASLYPLIQTYQRAFPGFDLVIPDHRGTGRSSRICPVQESPESPEGTGLAGTEWGPCIGAMYANLQRTSAFSITEAAQDLGILMSDADRSGPVLLYGVSYGTQLALRALQVNDLRVDGLILDGLVPPETTETFDLSRRTALVDQVGRDSMDERSLERYRTLLAVKDAGWQKEVPGGDVRRFFAALLSFPALRDRIPRIVQDLSAGDDRSLVATVKDWNVALAQLGQGGNNQPALPLVMLIAASENNARPELGMATVNEEAKDALFVSPIPDLLVNGSVPRYPRDAWFGTSPRTLPRTLVIQGTLDPNTAYAGAKEHAATLGRSGPVTFHTVDRGAHLLALVAPRCFVAAVDSFIEGAVISERCAEPTPE

SEQ ID NO: 2587 - protein, 776 aa, Streptomyces sp.
MSFPRRAFRRMRTVALPLVLSLAAGGLITTTAATAHAATYGTVREAFNNTAISPDGEPKAADFDAAGRSLSATDLDKAGWRRGTRVTVGATTYTRADVAPGQPDNVLATGQTLAIQGAGNALGFLASATSGPVAAPVTVTYTDGTSAQQTLEVPDWSAGTTTTAALSLAHHNTPSGQQTSPARLHAVTVPLDPRKTVTSVTLPKTGSSAAPGAPGLHVFDLSVRSTPSAPGGKFWAGSWGASFGSAQPVAQPGWAQQTLRMVVNPHTSGGTARIRFANTFSPQPIRLGHVTVAAQAGGATAAQAPVSLTFGGAAETTLPAGGEIYSDPVTFPVTAGKNLLVSIYLPDQVTTVPTHDYALTTSFISNRQSGDHTADTAATAFPGTLSHWTLVNGIDVAATENIGTVVTLGDSQTDGAHSTPDRNQRWPDHYAAALNATSRPTGVVNAGISANRLLTDRADIAGPSALSRLDRDVFAQSNVRTVVVYEGINDLAHDNASAQAVTEAIRRISARAKARGIRVVVATLPAFGGYSAYSDAKETARQQVNAAIRTMTEADAPTDFDLATRDPDMPSQLLPSMLKPGGGDHLHFGDAGTKALADTLVRAADGPSVTMSQTAAADFNGDGAQDLVAREDSTGILKMWLGRGNGTFASSTDVTAGWRAFSQTAAADFTGDGKADLIARDSSGTLKLWKGHGDGTFGSAITVTGGWEFTQTAAADFDGDGKADLIARDSSANLKIFTGDGKADLIARDDNTADLRSWAGHNDATFARPTTVTGGW

SEQ ID NO: 2588 - protein, 360 aa, Streptomyces sp.
MKHRRIPSHRIAIAGAGVAALVAGAFTLNSANATTADPAPAPATLSVASADKLAGTLLSELGDEAAGTYYDAKERKLVVNVVDEDAAEGVRERGAVARVVEHSLAELKSARATLKAEATIPGTSWSVDPVTNKVVVTADSTVKGAKLEKLNKVVDGLDGRAAVERVAGEFKPFAAGGDAIHSGGGRCSLGFNVVKGGEPYFITAGHCGEQGSSWSDSAGGAAIGTMEESSFPGNDYALVKYASGADHPSVVNLYNGSTQEITQAGDATVGQQVQRSGSTTQVHDGEVTGLNETVNYQEGSVSGLIKTTVCAEPGDSGGSLFAGSTALGLTSGGSGDCSSGGTTFFQPVPEALSAFGASIG

SEQ ID NO: 2589 - protein, 429 aa, Streptomyces sp.
MFPTSKKLRTTVAGLALTAASMGLVTATGAQPAVAAEVCTGTASVYGILGDGRLTYSAINTKGDRLKTLIGPDLGFTPKAMATLNFNTILVTSTAGALYRVDVLTNNNALELSGVEKIADSGWTHDKLAYDGYGHLYGTTAAGNLLQYLVSQDKPQGSQHIGQRKEIGTGFVLKTLTATGKDRLLATAADGRLLSYKIIGSAWKRDDLKNDGWSAFDELTSSGGGFYFGRIPTTGAMYWYKDGNISDGSGSDIVYHTNDPVDTSGWTQKLLSAAPDTTSCKQVNTLGQDIAADANREVGNNFNDFDFNHARAWCAEFVEYIWAGNSVDHSRELDARAISLKEYGQRHGTYRTSGPKVGDAVLYDVDRNLNDGEADHVNIVVAVSADGTQIQTVGGNESGKVSKAGWFNWDTASSPVGAGPVLAFVSPKG

SEQ ID NO: 2590 - protein, 328 aa, Streptomyces sp.
MSVQKPASNANATQAAASPDTAQSTTAPGSSVTPAAENERAAPTVESSSAPGSPSEAATTATSAAETGGSQARESGESAADEQRTAVAVAAAPAIPARTASGVDSGRPRKPVLAVAGIVGAALIAVPLLLAGGVDEDKRPEGPKELAAGESDTVLDPGSAGAALDDYVAEKPTPTPTVEKPEPSAPVKAVAPPPAPKPEPTTSAPAKKVMPKPKAKPTPKPDWTASTVRAVSTLEVSQAWTTNRIRMVMQPDGNLVVYNEKNKPTWASMTFGENHRAIFQSDGNLVIHNGDDRPIWASDTWGNEGAELILREDGKVVIARSGKVLWST

SEQ ID NO: 2591 - protein, 121 aa, Streptomyces sp.
MGRSLGVAAAAVAALAATALPAVAATDAAAAAPINRTNCNQNDYLEIHNNNGRDTLCFANAGEMPVAIYGVNWVESGNNSVTFQFQRNESDPRIETVTLGKWSQWNPGQPYLHKILWIKIH

SEQ ID NO: 2592 - protein, 566 aa, Thalassobacter sp.
MLDFGMAHYQAALGGAFLTFLGSIPAAADMNPTEERLFLLLKSKPSFMRAMPAGREMRELVFKGRAVPGPLEWGESPTEIGIKPIGLVTHVARNCSNDTVGVISDTFKASYEQTQSWEVTVGTELTNSVEVTASLPGVVETTAGTAVTLKFEGSKGGETKSTKSHDAGYSIPVKPGRELDVQFQITEQVIEGTPFSIEMELLGKVEITHPPQGNWVRYRGSVPAKAVSAGKEWNAAGTKRRDLWVCRAAGSPHIGKVIGRRCNYGYGGQEKTTTNFDVLVVAGLETNWVGKSQFESGDDYDEDIVAEGKAEVFYGGQESRPTKRYKGWTFVCRAKHKGDFHPGKVVTNDCMIGYGGKELQKGRYEVLMRGKEVGDVTPVDLQDHLPDAAERTFVVEGVFEDARSFGATTVFGTSRPVNRTVCPGYVPPQNDTSIRDVEVRTSEPVTYSGDSVAIPAAYNDSREQPKEPKAQGEPAINGTVLAKISYGENGEARATLVSRILRDLRADMFGADVVAVQQALNDAGAALQVDGYFGAKTARALREFQRAQGLSVDGVFGPQSQNALGL

SEQ ID NO: 2593 - protein, 223 aa, Virgibacillus sp.
MPTSYMDYTKPGVAFFSDVNKNRLFTRNDENYINQLGRNELNTLGNVSMLDIYLSNGRVVEPHYHQNASELVYCISGSAVVSLINPFNNEVSNIPITPGQVANIPQGWWHWEEATNNNTHLFAIFDAPYPEYILGSDILTKTPVEIMAHTYCLDPETWKEAIAPINESVIIGPTDECTREREDHQGYSQPYYPETNTNYPYTVPQYGYMQPYPNYYYLGYGYQ

SEQ ID NO: 2594 - protein, 826 aa, Xanthomonas sp.
MNDYQSEIALIRQSNSLEDIASIARQHAATTEKEGGILYSRPIGKVSSEGAAVSLSKETGLPIINDTPRANFLSDEDVRSSIEKKAREIFEDLGHDPTTARKSANSFLYGDPNVPSQDPTSLSRCLWGEASQEFASSLRGDIKVVASAANLERVFGQVEVPAVLNNPNVTSLGGQPVPKLQALYAQGGASAVLPEVQTQFIQAAPKGIFTTAESIGNEVKDVTFSREFAGSFDLKETHFRSSAELSASGMVRAPTGLDVPAANLAETALTAEAAASRRLSPGTVRGLGVVGAAAAVYDLGGTVRNTERLDAQGNSTAADAEVTRYATRNLGTFGGAMLGSSVGAALGVESGPGLLVTGAVGGIVGAVGGDKLADVINDHRISHQQDAQGNTWRLENHQAGERWARDVSTGEIDPAAVAFGEAGVPLYKTRTELATPEVADLLTFKASRTSIELALGSPPQNKDPYTQPAKEHDTRSLRESPWLHNANTQQWTRQVADGLIDRTMSTHTETASPQRASQLDEASRQIIKQNAMHTPAAMAAHYKETYEQNGWERHAYMPAAVHDALKHPGRIVGSDGDLYERGKDGQWTHDGMLWDSQAKGNLKQELDGTYAAQTLGTQRTAAQPVAQTAAEPIKTLETIHVTAPRMQNHDNADTSSKKTQEDTDVRGHSAPTRPQASGPQDPDHPDHPMLKQIREGVAKIDESVGKPYDEMSERVSRCLLAACKDNRERYPEAGNTSLAANALQRVDHVLMGKNGNLVAIEGRIDDPTHKRAAIPIDQAINMPLEQSDAKLQAANQAIAQEQTQTRQQELARSQQQDTQQAPRVSF

SEQ ID NO: 2595 - protein, 826 aa, Bacillus sp.
MAFIQRYSTTTNGAVTFTGNTLGLSNINISYTDIGAFITLDLSKQVPGYPAGTTLDWKENASAAQLRLPTGSIVLYAELIWGGSTKTSTEDVTSEIDRAITLISPKGSTLITPDPTTSQQVAQANQIFYVRSANVTSFIDAGGAGNYTVSGVPATVQRYKGNNVGGWTLSVVYKDPTLPLRNMNIHVGTASIEKTGSVSQKISGFSTPELGDVKARLLLTAMEGDSKIPGDQLLFGKDASSLKPISGPNNPIDNFFASQINDDAGNLDTSGTYGNVNVIPGSAGPAVRYNWDITNVDASTAMENSQTEALVQLTSKSDGYIVTGLGVQIDVNSPEIKINKEVDKEAAIVGEILTYTLLIENSGMTEAQKTILKDTLPPELKFVEDSLQIDGVPIPGGDPTKGVDIGSISIEGPTEVTFQTLVLKVPPDNRAVNKATVVYDFQSAPGLPVSSGTADSNEAITVIRKVEVEVVKRQDMSVYVKAGNIITYTIEVANTGDTQLTDVVIEDQIPNGTKLVTGSLQIDGRPFSGNIESGVNIGTVEPGTTTRVTFQVLIDNPVPKKVTNKAKVDYKYKLIPDGQIYRKVEMTNEVTAIHESNCKEAQKKIVTGIGEAELAAAGVIVAEKLKIQDAIRAFNEGKQSAEELLNENEQLTHKLTKTILDEKLQQDTLQKAKILCCDGIEGIDYSGVYIIKNKGSQKVLDISSASKDNGVNVQQWDYNGGDHQKWELEKMADGYYKIKAVHSGKLLTVSGASNSDGANVEQWEDIGGDHQKWKIEKNSDGTLKLIAKHSGQLLDLKSSIQNNGANIQQWPDNGTDAQCWELTKLK

SEQ ID NO: 2596 - protein, 811 aa, Bacillus sp.
MNQNYKNNEYEILDNGNAGYQPRYPLTKAPYSELRNMNYKDWMNRCPNRIAVVPAEGYDVNIRDAVITSINILTSLLSLAIPVAGVAGGIISAIFGWLWPTNTEEVWQAFMSAVEDLVDQKIDDFAREQAIARLRGMHGVLELYETAVSNLQKDPQNERLKENVRDQFVATNTFVVGSLPLFRVRGYEVPMLVAYAEAANLHLLLLRDAVKFGTSWGMDAATVNGYQRNLETGITVYTDSCVETYNKGIEKTKTLKANVKDYDRYPWAQYHDLLPSLGGSPEKDFQNIENWNLLNSFQRDMTLMALDLVSIWPTYNSKEYPLPVKAQLTREIYTDLRGCYAGDINSTEAQIVRPPHLFTFFQSATLYTGNNPFTPYVGIQQSGHYTLGPSFTTAVNGISEGAPNTVTANPSDAIINKVDIDTGNELYRFMFYQENYTQPFKTVGENSSLGYVRTINRIPIEGDQTLANHRMSWISGSLRPASTGPMGTQIPPYISCAALGWTHISANRDNRIVSDRITQIPAVKAYWNRGAFSVVRGPGSTGGDLVRLSSSGEVSIKVRPSRTGIFNYRVRIRYAAVASGKLNVKKYVNHIHASTTYDYKQTTAGNLTYSSFQYLEVYNFTLAESQFEVWLTNETGGPIYIDKIEFIPLTPKPEPKPIVPDGTYQIVTALNNSSVVDLDQSPTPPNWASPRNVQLWGNGNATNQKWKFVYDESKYAYQIINLANPKEVLTWSFNVERLSEVNAVPNQQDNRQYWIPEHAGNGYFYLKNMEDANEAYGALDVSNASTANGTKIIYNGFNGGTSQKFKLNRLS

SEQ ID NO: 2597 - protein, 1257 aa, Bacillus sp.
MDQTITKIRAAVHSLFSNHNLQLSITDYDIDYTAYLVDCMSSDICSQEKMALLDQIKFAKRLSRKRNLLNDGDFRLSNWSDENGWRRNAHVIFASDYQGRYANMPAATTAENGTIVPTYLYQQVSESKLKPYTQYLVRGVVENSQDLEVFVLRYAKEVSKKINILNDNSYPNLLHTNRDGHQCYERYPKQIMIQNSIDRYKKPHEFTYHIDIGELNLNEGPGVCVGFKIRTTDGIATLANIEMVEVQPLKGDALARIKKREQKWKQKWIEKRMKIEEAVQVAQDAIQHLFTCPQQNRLKWTTSLTDIEYAETLISKIPYSYDQLSLGEFPMLPREAYDILQQLSAAVTKAQALYAQRNIVRNGNFRDELSNWNATGGIEVQPSQNTPSMLVIKDWSASISQDVCVNPEHSYLLRVTARKEGLGKGYVTISDCMENNTETMIFVSDEEKMVSTESLRDTTIESARIGETLDTGSPNRNYPSESFGFTPYDDQNQMMNQSPNQYEMNVYSNNVNTTNGHELGCGCRTNAHSSECKSMYTSSNHDERNAYLTNGNSITTNETILSSSPIPVQNSSFLSGYVMKTVEIFPETNRVRIEIGETEGTFIVNSVELIQIEQINEMNNQSVDVQNVAYDTTITQSNPVSFTEISASPRHTHYAYSHDSNIGYENPNWMADIPDDTMFSDLSIPGTHNTMALYGGDVTQCQTMSLNTQLYAGVRYLDIRCRHIENVFAIHHGPVYQNAMFGDVCIIVRDFLRKNPSETVFMRIKEEHTPENNTRSFSETFADYKSQYSELFWNWSSDNPKLSGIRGKVVVLQNFSGDRFGISYNTLNIQDQYSLNTNWDLYDKWLFVKDHLYAADASYKNGRKQAYLNYLSGSGGSFPYFVASGHSSPGTNASRLSTGLTTPAFASWYPDFPRVNCFIGICTIAFEGTNILTSNWIEGSDFKYVGIIAADFPGGGLIDNIIYLNIGKGTVQDGTYQIITALNNSSVVNLDLNQPHDNVVLWNNNFSNNQKWKFIYDTTKSAYQIKSVLNENLVLTWAYDSGDRDNVVATSNQYKTSQYWKLKYIGGNYRFINLVDLEGALDVNNGNTGNGTHLLYWNFQNSSNQKFRLIDTSKGIIQDGIYQIVTALNNSSVVDMNPADKNVHLWQNGNANNQKWRFVYDTSKGAYQIRNLSNENLVLAWNDFQGSNNVFATLNLFYDEHFWIIESSGDGYFYLRNRKNVNKVLDITNGSSANGTNIIVWNYQGSNNQKFRLQQLN

SEQ ID NO: 2598 - protein, 1569 aa, Variovorax sp.
MKIRYFLMAFLAPLVTLLTHAAITGVSPMTTLNNMATAAAEAVADPLPLQGPGLGNLTYTSAELFKPVSMITSLAHPLDPAHSSAYESREVPATYPGRKDYGMNAGIMVNGYFLTSFAPDSGLGPGGFLLYDVSNPRQIQLVKKIYEPEARTKEFRETHSFGTAKIGGKTYVVLPSIYGVEFWDFTDINDIKQVKKLALPGVNAGDYEDVSWQLWWQAPYLYVASAGRGIFIVDAGDPVNAVVANRGAGKPNPVPTGELGNFRIGPIFTMGNHMVLTAMESNGGFASLDISDPLNPKVLDSIVGTTPFYYATCFDGRNLHASTRGSGARMYSYDLSDRSRFVAEDNRLVIDEQLYCATQDNYVIQGAQTRIHKVDVSNPLNHVEVGRGSILREDDPNFSHSDNGQVAMFGNLVFVGNDHGSGSGFVVHAVDPDTTRPEVKQVSPANGAKQQALTSRIGLGMTDSIRPESVNANTFIVRAVGGNTLAGTYSVQLGIINFHPEQPLSPGTSYEVFLPANGVKDYAGNAIGADYKSTFNTGNATDINLMHYWTLAGNLSDQIGNNNGTPVSGDAFESIGMSFANRTAGVPLKNDSVATVLGGTASLSFYMKTTQAGGPNSWTAPGIFGRDQSGGADDVFWGWLDGNGRIKLSVGNDAGTTSTAVVNDGSWHHVVLTRDAASGAQAVYVDGVKTTSTGLTGNKGLSNKFQVLGQIQGNAALFKGTLAEVRVYGRVLTDSEVGTLRGQAIIGDPGIGGGPKIVNGQLVFDPATLGSSGAQFRWNFGDGTQTAYSTQPRYTYTYTRPGHYTVTLTVRDASGRETFYTYNLTVIVPVTARAPTHTTNIAGDANSVYSLNPDSGTVAAIDAQTLAKRWEVRVGDEPKTLAVGPDGRIWVTVQGEDKLVALSAADGSLSATVPLAYGSGPYGVAFTPDGAKGLLTLESKSVLMSFDPSNGTTTGAVALEGSLRGIAVSSDAQVAYVTRFKSRMTGGQLHKVNLQSMSAMPTIALPVDTTTVDTESRARGVANYLSQVVISPDGRRAVLPSKKDNIVRGRFRDGVDLTHDQSVRSILSQVDLQAAAEVFDEQIDFDDRAPARAALFSPPGDYLFVAQMEGNRVAIVDPYSRAVRGEINASSAPHGLYLDAARKRLFVNNFLARSVSVHDVASVLSSESAAAIFLQNVSTVAQEPMAAAALRGKQVFYNASDRRMSKDNYISCASCHADAGDDGMVWDFTQRGEGLRRTISLMGRRGAGHGKMHWTANFDEVQDFENDIRNEFGGTGFLTNADFAATADPLGAPKAGKSAQLDDLAAYLSSLNKYMRSPARAADGSLSVEAVRGQTVFNTAQCATCHTGGTFRDGLRHDVGTIQLSSGKGINQPLAGLGFDTPTLSGTWNTTAFFHNGQAATLQDVLNSGHGNASSLPAPDVVALREYVRSLDTAPAVVTRIRSDLNPTMCVNIKGGATASGTVAVQWPCGTASNEKFTVTSITGGYVQLVAEHSGLCLAQNGTATTNAPVVQLACTAGSTAQWSLVGGTLRNRGSGSCLDVPNGSTTQDTALITWTCNGGNNQNWTQLP

SEQ ID NO: 2599 - protein, 68 aa, Actinomyces sp.
MDKFTRRTTTLSDSDFSQAVSSETQAPIEGTEDLSCPWAPSVCNRHCLSHGYRGGYCAGPIKLVCHCY

SEQ ID NO: 2600 - protein, 354 aa, Arthrobacter sp.
MKKSLATFRTLAVSGVLGLAVVAGPAPLANAVGEGPNYDGNGQITTSKLATYDQMVSFLKDQDARQSAMELEVIGQTVKGRDIHLVKYISDPAKPTILYLTQQHGNEQLTTEGALEFVKHLGTGKSADILDGVNILIVPMLNADGAMGDVNFPLDDYLAKGDRNMTRYNAEEVDLNRDHVAKIQPETQALHNNVMRKYNIDYMIDLHHQGTRSERDGELVSGSILYPTTPNANPAVVEKSKQLGAVVFHNVDSTGWGHLGKYVGGSAETISRNGIAVEYGIATLLFEMRGMSDHYLDGYALGLRSNGYLIKQTVTTLTATAAAIADGSIAGADTSFWDSLATQTSRPGGEADDE

SEQ ID NO: 2601 - protein, 274 aa, Bacillus sp.
MKKQLVTATTAVVLGTTLFAGAASAQTIKVKKGDTLWGLSNRYGTSINSIKSENKLKSDIIYIGQTLSINGKSSSGSNSGSKSSSSTYKVVKGDSLWKIANKYKMTVNQLKSLNGLKTDLIRIGQVLKVKGSTSGSASSGSSSSKKPSSSHNIAQTSLNVNKLVSDAQSLIGTPYVWGGTTTSGFDCSGFIWYLLNKQTSVGRTSTAGYWSSMKSVSSPSRGDFVFFTTYQAGPSHMGVYIGNNKFIHAGSDGVTTSDLNNSYWKPRYLGAKRF

SEQ ID NO: 2602 - protein, 128 aa, Burkholderia sp.
MPSPASLARLRPGTLRAAGLALLPLLIALPLAAQAASFDCKQARQADERAICASRALSEQDVEMSVRYEMLMGLVAMGTRGDMGEAQQQWLKRRARCGASQSCLATAYRERIDALKQQYRQLQSRGPF

SEQ ID NO: 2603 - protein, 163 aa, Collimonas sp.
MKGFTPGLFDRLMGGDNTPAQSDLVVRLSMDALKDTVARDLEAMLNTRTVIPEELLKNFPECSKSILTYGLNDFSGMSLASLDDRAHICQCLEQGIARHEPRLRNVRASLELREGSINRLNFAIAAMLVVGPAKEAVSFDAVLQPSTLQYSISRARRAMRMDG

SEQ ID NO: 2604 - protein, 751 aa, Collimonas sp.
MKKFLLFSLSGTLLLLAVFSSQAQAAIVLENPLWHIVLDPGTLAIRVTPAGAAAVQVSDGVGSHRVAALQSTADQAGWQWDDGAYRIEAKLSERDLMLTVRANAAGALTLIRQPGSAIGRGLILPLAEGHYVARDNKVWNDFILQKMGRLNTTQDLSLPLWGMDHGKFSLHWLLTNPYNNQLDFSADGSGLALQASHTFTQLAPDTPMTLTLHLGDGDLLAGAKHYRAWLLAEGRFESLAEKTAKSPGAAKLIGASHAYLWGSGLIAAKDVRSWPAFLRILRSKNPLAIDLRRHFAPESRKALAEAGTNPARYQEKILVGAFNAGLNSLAREAWQTDAPDVNRLASRYGELRSEVARAFGAALNADAKDWGGGVSGATMEQLRKAGLARLWLGLGEGWEGGLWHPEAIAAGVKAGYLLAPYDSYETALPRGHNPDWATAHFGEKTYRDCAIVLDDGRFKTGFNGFGHYTNPFCMRPLMEARVRAVQEKAGFNSWFLDVTAAGMLFDDYRRRAAMTMAQNAYANAASTRWISEDRQLPAGSEDGNAVTAQGIFFAHGMQTPVIGWGDKEMQKDKKSPYYLGNYYPPEEPSNMFKAVPLKALYRSIHFDPAARLPLYQAVFHDSVITTHHWLFDNLKLTNVRRENELAQLLYNVPPLFHLSEGTLASRLPLMQRQDAFFRPLHEKLANQALTGFRWLSADRLLQQTGFADGTMQVANFSAEERSFNGRRFPPYSVTALTADGKTTVFVSEDGR

SEQ ID NO: 2605 - protein, 503 aa, Collimonas sp.
MIEERDMRTIVSNTLLLGLAGAMLAACSDGGSSGVSSASLQQVSAKASAPACAAAWVASAIYTGGNSASYSNVNYTANWWTQGNNPSTESGPIGSGKPWTSAGACGDAAPPVTPPPVTPPPGATTGTINFHLLLGAGSAQDQLLLDGGNYNDLIMSNIVAGVMYGHLLQQYYPGMQFQKDYLYGSILGQLLQENIATGLYVSSGNLIDPSPDQQAVMATGQGGPYQINNYAADMVSGSYAPAGHSLINYVAIQKNIGYTMANAAQQYSKPTPPSFNNKYYGPMLTAYFHYNDFVALIVTGKGMGGWTTPWQPDYDNALVKFTKLPNNFLDVLLNVAYNQGFYGTLMSSYSKLAATATASTVTSVNAYSSVWGATDTYKQYPYQVRYYLDQLYDNPIPTTSATTFVTPANHVAFGVAALETVFSNVFQTLAYVNGSGQSAYISAAQAQAAFNSALATAEVAAGATLDLSNAANRAQIFSVLEKAIGNLETSLNTKFNATTSVQL

SEQ ID NO: 2606 - protein, 420 aa, Collimonas sp.
MKLPAAWLIPVCGVLAASQASAWEKYGIHSVYPAAISVQINPSQISNQQLAAIKDAGFEYVRFGTRPPVSDKPQDFSELLERLRKAQLKPIITLFGGATVWVQPKRMMSATMTPLDAADNFSKFALTTLNQYADPNILWELWNEPDNPTFLKPGMLQAGLVPAIQKICSALEQQKGGVKKNIFGFGFAKLPNLQPKIPDDKLLAISLQNCLSGVSVHPYRKIPETLADDATKSRELLHKYGKGELPMIASEWGYSNFTAARDQGGQAQLVLREYLSTVFAGIPLVNIYQWQDTGSDRAAREQNYGLTDSSGQVKQALPALKHLLGKLKDTQLAGSEKVGEAYQLVLNSQPGAAAKRSVHVVWSSAARSGPGGGFSIPRNKGQRCIISEFYPQQGDKPCPEGAGSVDINAGPSPLAVTLYD

SEQ ID NO: 2607 - protein, 501 aa, Collimonas sp.
MIASSLPIVAFIGDCMKRIFTCALIFLFVAVSAQAATAGYSGYTGAASIVNGVPGKVATASLGAVVDATVLDQVVVATEAGARVTVPVSTTAAVAAEGIAGAGLKLVPYLGAALTAAQVASMLKNAGLRYGSCSAQSWFGLPAYCQQPPAADQYLWHGGFGSNSSVPYPDPTSACQGDMAALIRSNSTWAGWTMTLGSSSGPDVVGCVLVSPTGVVGSSNFTVASRYLNPNPGQLPPLAPATGDDIAGALKLQAIQDSNARKALYDAIKSDLAAHPEYQTADTNPVQPSTPASVTASPVISPTVTTRVDTVPKSDGSTDTVTTSQSTTVNPTTTGTTVGDIKTTFPSTTTTTVTTTNNVTNQTTTNTSVTSNPAPSPELKIPDDYNKEVTQKQVEKDLNTDAAPPMDDQQKVITDANTKGDTDRDKIYDDIKSGQQDKSSWFSWVWSPPVGVCAPITGVIAGFHVSWDLCPSIAIIQAIIGWLMGIFSAAEVYGQLFKRED

SEQ ID NO: 2608 - protein, 775 aa, Collimonas sp.
MPLSKRNRLISRLFCSVFLAGVLSGLAGSASAAPAAADSATSPARPRIGLVLSGGGARGYAHLGVLQALEKMHIPIDYVAATSMGAVVGGLYASGLSVDELDRILTGTNLSDIAFDRNERADLPQSQREDDYQYPIGLSAGYGDGKLKLPAGLVQGNNLLALLQNWTPQLPANISFDKLPTPFRAVATDLGSGAEVVLSQGSLPRAIRASMAVPGLFAPLKLDGRTLVDGGLVRNLPVSLARSMGADIIIAVNIATDLQDPSTLESPTAVAQQMVTILIQQNVKHEIDTLKQQDVLIEPNLGDLSFADFSRGKDGVKAGYDAAERQSAKLAALALPPQQWKEYLAARSGGGPVLAQDTHIDAIEIRSNGQVPAAVVRRALDVKEGDFYNPVALNKDVARLATNGDFKSVTQELVTENGRNVLKVDADDKSWGPHFLLFGLGVSNNFDGRGDFNLQIGHRLPWLTESGLEWRNDAVLGSKQASLHTELRQPIWNTVGLYVAPYAEYGRRHIDLYTDEGAVTSKTVPVTAYRVDTTRVGVDLGIPIGRLGEFRAGVNYQWLTAAPAYNLPTEFANLIGVDTIFDKFRINQPVVRAQLTIDQLDDPLFPRKGYYLSAVSNIGLGGAANSYSDAQGKALWAGSRGRNTVNLALEAAGTYGNETNDASGNGGLGFSLGGFQHLSAYAPDQFNGNYLLYGRLTYLRDMPELNLPGLRNTVLGTSLEMGDIWQTREAFGTGSYKKSASVFLGGSSFLGPLYFGAAIAPRGVWNLYLQLGRVF

SEQ ID NO: 2609 - protein, 661 aa, Collimonas sp.
MMQTPAPNQLCIADRNAGLRRLLSVPFKRNKQMKSEISAKALAANFAIPQASALSLALSLVFASLSVHAAVADNSAWVTTKTQAFLPQVQANQKSVAADASVVTPAATAVQLAQGEPVHVTLSLNLRNEAKLDKFLQDLHTPGTASYGKFLTPAQFAAEYAPTEKDVAKVVAHLSKSGFVNIQVAPNRHLVTADGTAATVQTGFRTALKRFQQDGRKVFANTDAAQVPAALSGIVDSVLGLQNVAIAQTHHRWVQTPEAGVSAQAKVTVNATPVATAHSPVQFPAIYSVGTTPTASNTVVGIISAGDLSPTITDLKTFTTAKGLATVNTLVVKTGAAGADYSDTSGQVEWNLDSQTITGTSGGVKQLIFYASPDMSFSGITAAYNRAVTDNVAKVINVSLGGCESDTHSDGTQAADDNVFKQAVAQGQTFSISTGDAGTYNCQTSSISGAPGVPKNKSTYDVSEPAASPYVIAVGGTTLYTNSGAYSSETVWNEGLSAIGTYDDAGDYDSTKRLWATGGGYSKYEAAPSYQSGVIAAGKTTRGLPDIAFDAASASGATIYYNSQTGTVGGTSLAAPIFAGVWARLQSANNNALGFPAASFYKYFPVAANASLLHDVTSGTNGASSSYGYKAAAGWDATTGFGSLNIGNLNTFVKNTSDFAR

SEQ ID NO: 2610 - protein, 183 aa, Collimonas sp.
MTINKILATMLIGVAGFSGTSLALAADSAKASYKAAEDAADATYKADKAKCDELSGNGKDVCLKQAKATREHTKQDAKAEYKNTPKAVAGARKSEADADYAVAKEKCDALAGNAKDVCVKQAKADQTNAVANANTQKDVSKAKADAREERADARYKVAMAKCDALAGAAKDDCVAAAKADAGK

SEQ ID NO: 2611 - protein, 124 aa, Collimonas sp.
MRLQKYTSNCNKYVIIEYQVSYYSQQIQADIMSLPATLQARYLSLTARMKIYGPHLGEPHTKVLGNGLLELRLKGAEGIARVFYCTMVGKQIVMLHSFVKKTQKIPFKEKRIAEIRMREVKNER

SEQ ID NO: 2612 - protein, 501 aa, Collimonas sp.
MNRSLQIPRRILLAALISACCVLPAKLAFAVQNLPTLGDTSRESLSPLMERKLGEEVMHDIRRDPDYLNDAPLLEYLNNFGWTLVNARPEVRGEAGFDFFFFAVRDPVLNAFALPGGFIGVHSGLLLAAQSESELASVLAHEIGHVAQRHIARMVGSQKQDSMIALASMLLGALAMRGSGDAGAAVMMGGTGLAMQRQLNFSRDAEREADRIGLSILDSGGFDTSGMVAFFGRMQTASRNYSDVVPPYLLTHPLTTERIADIEARIREQRYRQRADSLDFQLIRARVRVLQDDTEQGRRDAQIVFDAQLQLNTKQQIVAAKYGMAFLAFKQGAYDKAEDLLQQAVAAALPAKQSLVLTDLGVEIMLASKREAEALKLVQQGQLQYPLSRGLAHQYARALIASKRLDDAIKYLREQARLYRQDADVQDLLAQAYSAQGKRALQHMALAESYVLTGSVPAALDQLRIARNSGDAGFYDQSMIDARERELQERWKEELAASKER

SEQ ID NO: 2613 - protein, 381 aa, Collimonas sp.
MKKILAALAATVLSISVAFAQTLPPPTVAAKSWLLLDTTSNQVVASQDPDMRIEPASLAKIMTAYVVFDALKDKKITLDQMVNVSVRAWKVDPSSSKMFIEPNTPVSINDLLYGLMVVSGNDAAVALAEAVAGTEDSFVALMNHEAERMGMKSTHFGNPHGLPSADTYSTARDLATLAAHVIVDFPEFYKIDSTKKYTYNKITQPNRNRLLWLDPTVDGMKTGHTSSAGYSIIASAKRPNAGGDRRLLAVVIGTNSDGTRTQEAQKLLNWGFQNFDAVKLYAKGQAIDTPQVWKGAKSQIKIGFTHDVYVTVPKGIADKIKPVLERTDPLIAPIQQNAKVGTVKVNADGKTIAEFPVVALEDVAQATIFGRAWDSIRLLFK

SEQ ID NO: 2614 - protein, 101 aa, Herbidospora sp.
MKRILLTSALAAVIAGTAGMAHASVYVAYEGPGFSGRSVALSACGINNIPFGGSYKWYGTGQSGRMYNLPNAQGVAHFTLDSNRNAEQITPVGWKSVFIVC

SEQ ID NO: 2615 - protein, 478 aa, Lysobacter sp.
MDGRTTHYRVIQLGAPKGAGGVQSNEVVSDFDSLVTHHPGNNRNAHLENGLVVGGERTRQHALIGGEIQEIEIVRNGNTFQGLKPDQVLLKKDFMLEAPGQANPRQVDVPSPVAGVVGRVSHAEGLVDIHDRQGGDVIARVRHMRDIELEVNDAVAYGQSLGTQHRVATEKVHVHMEVDTRYYRQFENYVGDLTEGRLPVEAAARLGVEPRAVADDGVLRLGESSLRIRDLQNHLNGMGYVGADGQALTADGVYRLNMQRAVLDYQREQCLPQTGDISREMLQAVPARTPGPFDPALGGIPAPGLPYAPMPHPFGTGADDRPCAPPTLQQIEDAAERRRPWDPAFSAAPPSISSDPLVQSIRERLPQAFATYGAAPPEVELDRIATGLAVECRKQGIERPDHIAVGNPATDGSGRHVFAVVGDLRDPASHRVDVAAHAAAQVPVEASLLKLDALQASTPALVQGDQAQELQKAPSMRV

SEQ ID NO: 2616 - protein, 270 aa, Lysobacter sp.
MSKTTRTPTLAMASCVLASLVLIGCSSTVVREPSRGGGRPSASRPSGSRPAPPPASRPKYGATVTVQRGEGLYRIATNNGIQLADLAAWNNLSPPYNLYPGQRLRLYPQSGGRPSSGSVSAGSSVAGGTTAPRPSTPPPAPTASVDSGIRWRWPSDGPLLGRYLANEPTKQGIDIGGASGAPVRAAADGVVVYSGTGLVGYGELIIVKHNEQWLSAYGHNRKRLVNEGQLVKAGDQIAEMGRSGAARDMLHFEVRYNAKPVDPMLYLPAK

SEQ ID NO: 2617 - protein, 334 aa, Paenibacillus sp.
MYKTKFLMILLSFTVIASFSSLSGPSPSKAFAEEHGTPVQKTIDLNEGFDNSNEASTEPLSLTSEEATSQATVTAIDHDANFSPSTLQFLKANTGLDGEQWDNIMKLVNKPEQDSLKWTEFYGYAEDIGDNRGYTIGIFGATTGGSNDTGPDGPDLFKAFDAASGASNPSIAGGLTRAGLKGKMSGSILKLSDSDSVIKKKINALQNNEAWREAMWRTFYDTYIEYSVQQAQKRGFNTALTIGSFVDTALNQGATGDSGSLEGILSRSGSSTNEKKFMTSFYAKRTLVVDTNDYNQPPNGKNRVKQWSSLLASGETDLKNADAAVIKATNWELK

SEQ ID NO: 2618 - protein, 222 aa, Paenibacillus sp.
MKHLKHIGKTMKFAVLAAAIAGLTQTAGVAAAASLHTAKEGDTFFLLAQRYGVSVDELTKANPNIASNNIYAGLQIKVPGEKSVKAASDSKPQLLTEKAPANEGPTIEAWGKTFNYSKIVDVKASAYSAAADENGKWGAVDYYGNPLKLGTIAVDPNVIPMGTKVLVTGYSHPGLPDHSFVAVARDQGSAITGKRIDIFIPGNKSFVNDFGFQNVKLYVIDK

SEQ ID NO: 2619 - protein, 284 aa, Pantoea sp.
MDQHIDRRRFMTLGLAGAATTALGATAIPDGSAQAVTGAAAPTAAPVLLAADEFDGPAGSAPNPVIWRYDLGASGWGNAELQTYTDSRRNAALDGAGNLVITAHREADGSYSSARLKSESTYTAQYGRIEARIRIPRGQGIWPAFWMLGADIGQVGWPACGEIDVMENVGYEPGIVHGTVHGPGYSGAQGISAAYTNPSGAAFADDFHVYGVDWRPGSITWTVDGVAYRTVTRADVGSATWVFDKPFFVILNVAVGGNWPGSPDASTRFPQQMTIDWLRVHQNA

SEQ ID NO: 2620 - protein, 657 aa, Pantoea sp.
MKPLHAQYLFCCATLSLLSPLPAMAWSDLTVFGDSLSDGGNVGRFTYDGATHPLYDEIVAQSLGDNLRPSSQGGSNYAEGGAVAVPAINPLFNTQDQLDNYLAARGGRADPDGLYIHWIGGNDLAAAALAPLAARQIVDNSASAAASQVSRLLDAGAGTVIVPTVPNVGATPALLQAILQVLGPAAQPATAALFQSLSTTTTPDRAAREQAIETALGEAAGQISSIPLIRDAIAQQLIAAWQLLSQEAAALTDRYNQAEEQGLMAARGNIARVDINGLFNEVIDNPGLYGLTNTAGMACPPGVSAMDCTSSTTGFSQSQQYLFADRLHPSPAVHALIADYIQSVLNAPLQVAALSRAPSMLVGDAHNTLDGHLQQQRQQPANAGEFTVFGGYAGQQRDFRGDSLQDGDATSASGTVGVGYQLTDHWQAGAMLSTTSQRQDPSSRFDYRLRGNLVALWSQFNYLDRGWINADAHYADLDFDDIERQIRLGPATRTEKGNSDGKVLGMRLQTGWDLPLGSYVSTGPVASYALDYTQVDGYKEEGNSSTSMRFGDQTLHSQIGSVGWRIDSKDLLINPWAQVSYNHQFGDSDSAVTAGLKSTRTAFTRSSDASDDNWIDMAVGASVPLGTSVNAFAGVSAITGNSDMHQVTWNVGLNARF

SEQ ID NO: 2621 - protein, 345 aa, Pantoea sp.
MAAVAVVGLVVAGVAAPGPVEPASAAPMWPVPQPYPVPDDPTESLADLPPGSEYVALGDSYSAGYGLGDRTRLPTSACVQSARDYPHRLAARFGLDLTDVTCAGATSEDVTTGHQFTGVPPQIESLSSRTRLVTLTIGGNDADLFGTAASCLAISADGPVFSGRDAPSCESTLVQDGEDQLSVKIQSRVALGIADTLAAVQRAAPNAVVVFLGYPAIFPDAEHTPAKGCFRSALDLGTLAGSFPSDTFPFTDDDVAYLHGVQEELDAVSASAADAAGVRFVDVLERTEAHSACAPADERYVAGVSLTGSSDLRRIDLKAGALHPNGRGVAYLTDQMADAIRELAG

SEQ ID NO: 2622 - protein, 487 aa, Pseudomonas sp.
MSSSIRKAINSDALTRLAQAIAVAVSATLAGCSSHVPQPEATHVPNIAARAKQKPIWLSEKPTPQVPQDVWERMRQGFQLQDNLGVNPRIEQQRLWFASNPSFLENAGERGSLYIHYIIERLEERNMPLELALLPVIESAYNPMAYSRADAVGLWQFIPSTGRYYNLRQTRFYDGRRDITASTTAAMDYLTRLHDMFNGDWLLALAAYNAGEGTVSRAIERNEKLGLPTDYWNLPLPAETQAYVPKLLALSQVVLAPEAYGVNLNPIANEPYFQVVEINQRMDLSKVAAVANIDEDELFQLNPAFKQRTTIDGPQHLLVPTSKAQLLTASLSTMRPEELISSRPLKPVFEGADDNEIAKLKRAYRVKRGDNLAAIAKANKVDVKDLQRWNKMTGKNLKVGQTLVMQDNTKRSAGRINTVVAASGKSKGKDTGKTVAKTQQTYKVQQGDSLYMVAKRFNVEMQHLKRWNPRVGQALKPGQMLTVSSPR

SEQ ID NO: 2623 - protein, 256 aa, Pseudomonas sp.
MKPMNKLCLIAASLLMLGTGSAMAANIAPVKANNVVLVHGSWADGSSWSEVITRLQAAGLHVTAVQNPLTSVANDVAATQRVLDQQDGPTVLVGHSYAGTVVSEAGVDPKVSSLVYVAARAPDAGEDFVALSGKYPTMPVRAGTEEHDGYVSLKQDAFLKYFASDVPHDKAMELFAVQQPIAKTLFGERTTAAAWHTKPSWYAVSSLDQTINPDLERFLAKRMGATTIELPSSHLSLVSHSKEIADLILEASGRQP

SEQ ID NO: 2624 - protein, 477 aa, Pseudomonas sp.
MTFLRPTLLTLACLLASPGFADDLPSLGDASSAIVSPQQEYQLGRAWLAMLRSQVQQLSDPQLKDYVESSVYKLVETSQVSDRRLEFILINSPELNAFAAPGGIVGVNGGLFLNAQTEGEYASVLAHELAHLSQRHFARGVEASQRMQVPMMAALLAGIVIAAAGAGDAGIATIAGTQAAAIQEQRRFSRQNEQEADRIGIINLEKAGYDPRSMPNMFERLMRQYRYDAKPPEFLLTHPVTESRIADTRNRAEQAKQGGIEDSMRYQLIRARVQLIYEETPGLGAKRFRAQLDENPKNDVARYGLAIAQIKGGQLNEARENLKLLLTTAPNEIIYNLAQVDLDITNNRLPDAQTRVDRLLTQFPGNYPLNQVRVDLLLKQNRTADAEKALENLLKSRPDDPDVWYMVAETRGLSGNIIGLHQARAEYFALVGDYRQAIQQLDFAKRKAGGNFPLSSRIDARQRELMEQERMIKDMMG

SEQ ID NO: 2625 - protein, 579 aa, Pseudomonas sp.
MDFSLKQLAATTLVLASLASFTPLAHANITAQQSATILKAFSDASATDFRQFLGSVAKSELAKTANLGPAISAFLDNKTLSAEQQNEINRLLGIYARVKYGNAATETLRELVAIPTFQVEGVAQHDNPEFIKIADKIKGLAQAFNLNFRNIDNRVYEISLEGSGDEVVGIHAHADVVPVTPENWVLKDGTKLDPFKVTLIGDRMYGRGTEDDKNGIVVAMYAMKVIKEEKLPLARNFKLLVDTTEETSGDAIPYYFEHNPTPNYNLALDGGYPVVIAEKGYGTVMGNFPRRDGEGKGAEIISMTGGMATNQIPSASVAVLVTDKPAELAASLQKAGADYAKRNGGNFEVNAKVDGKDVKLTVTGVSAHSSEPESGVNPVARMLDFIHSIDGKVALKHNHITDAARYAADNWGLDYLGGKLGVGFSDAFMGPLTTSLTFVGMDDKTFKLAVNLRVPKGESPEALKAKIADKIGAWSKKTHVPATFTYSIAEPMYRNPEGEWVKALLAVSTENLGMEHKFGSSAGATSVHELPNGVQFGLARPEVKYTGHTDNEFKTVDQFLLDLQIVTEMMGRVGQLPKL

SEQ ID NO: 2626 - protein, 662 aa, Serratia sp.
MPLKITRMPRPAALAVAILCSMTTPALAYDQVYVFGDSLSDTGNNGRFTYDGNKHLLYDEVLAERIGAALVASDDGGYNYAAGGGVAVPALNPADNTQDQVQSYLGRVDGRADGDGLYIHWIGGNDLAAAALNPTTASDVAYNSAAAAAVQVRSLLNAGAGTVIVPTVPNIGSTPQLMELIIQQALTPVQGAAVQAAYATLNSLTTPDNVSRTQAIHQALTSAAAQASAIPQVQQAIAAQLIAAFDSLSAQAAQLTDFYNQSEDRLLAQGGGNVVRVDVNKLFAEAIANPAQFGFANTAGMACPAGVSSAVCSSATPGFDASQSYLFSDHFHPSPQAHLLIADYIQALLDGPAQVVALNQATAAMARDSRATLDSRFQQLRNGDNPQGSLGVFGGYAGQHYDYSANKAAGDGNATTHNLTVGVDYQLAEGWLIGALISGSNDDQQPSSRYEYKARGLLLSAFTALDLFEHGWVNADLHYATMDYDDIRRSMQLGPLTRTETGSTSGKQWGARLTAGYDFPITSYLTTGPMAQFAWDYSNVSGYSEDGNNSTSMRFNDQTYHSQIGALGWRLDSQFGLFNPYAEVSYQHQFGDDVYRAGGGLKSTQTSFTRDSAGQDKNWVDVTLGANMPLTDQVAAFAAVSQTGGLSSGEQFMYNVGVSARF

SEQ ID NO: 2627 - protein, 370 aa, Serratia sp.
MSATLKRLTFGMLLLCAFGAAAACEWPAWQQYKQFYISDEGRVIDPSSPNRITTSEGQSYGLFFALVANDRPTFDKLLEWTENNLAAGDLSAHLPAWLWGEDDKKRWTVLDTNTASDADLWIAYNLLEAGRLWKSRRYQTLGTLLLQRIGREEVADIPGLGLMLLPGKIGFVAQDRWRLNPSYLPPQLLARFAALNGPWRAMQKTNQRLLLETAPHGFSPDWVVWQAGKGWQPDTVKPDVGSYDAIRVYLWVGMLADDDEHKAALVKQLLPMAQLTAQQGVPPEKTDTASGKTSGDGPVGFSAVMLPMLANQTAALDVQRQRINQHPPGDDAYFSASLTLFGQGWDQQRYRFNRQGELQPAWGGQCVTSK

SEQ ID NO: 2628 - protein, 250 aa, Serratia sp.
MKKRFSLLAGMLFALTMPAHAAENIEAKAIGPKHGATLIPKARQVICEQDGGYNHPDDGSNIPNAACRNAFLYKAETIPIWERRQMFTEWPAYSQNLQGTQHPSDKVPDGQLCSAGIAKFEGIDQPHADWYVSSVSVKDGQATLYFDATQVHEPSKWTVSLAKPSFNAATDKLKWSDLTPLEVTKVTVPPPAKGNHVKYAGVYQIEVKIPADRADGKQTLLYVQWERQDPARETFFSCSDVRFNGESAAK

SEQ ID NO: 2629 - protein, 733 aa, Serratia sp.
MRLSTLVLAIGMALSSQAQAAETNPHASHSALPSGQAKEANVTGEANQHENKKNENPFFYQSRLPFQAPPFNLIKESDYAPAIDAGIKQKREEVEKIANNPAKPDFKNTFVALEQAGALLTRVMNVFGAMTSANTSDALQKLDEESSPKLAALEDAIMLNSKLFERIRAIYQQRDALKLDAESRRLVEVTYKNFELAGANLSDADKTRLKALNQEAATLSTQFSNKLLAATKDGALAIADKGKLDGLSESELAAAAQAAGERKLDKQWLLVLQNTTQQPELQSLKDRDTRKALFDASWNRAEKGDGNDTRQTIARLAKVRAEQAKLLGFPNYAAWKLQNQMAKTPDAALSFMRNIVPAATARAEREAKDIQAVIDQQKGDFKVAAWDWQFYAEQVRKAKYDLDESQIKPYFELDNVLNNGVFYAANLLYGISFKERKDIPVYQPDVRVYEVFDKDGKSLALFYTDFFKRDNKGGGAWMSNFVEQSKLKGTKPVIYNVANFTKPAPGQPALLSYDDVITLFHEFGHALHGMFADQEYPSLSGTNTARDFVEFPSQFNEHWASDPKVFAHFAKHYKTGEAMPQELVDKIKKADKFNKGYDMTELLSAALLDMHWHMLSADQPQQDVDKFEAESLLKDKIDLSYVPPRYRSSYFKHIWGNGYAAGYYAYLWTEMLADDAFQWFTEHGGLTAENGQRFRDMVLSRGNSQDLEKLYVDWRGKEPSIEPMLINRGLKDE

SEQ ID NO: 2630 - protein, 521 aa, Serratia sp.
MNLIYRALFYAFAVMLSFFSSTAVVAGQLILKNTSLSPITCTVDGWTVSSGSSFDWFIKVQPGQSFFVGQNTSRPKDPVINWAKCNNLQTRAMTITPSGPNQTLVLNGQQTQVLNVSLYPFLPTLPTDNFENLVAYIVQTYQSQHPQVLLNAVLNPQVNIYSFTELPVLLGNDGFDVIELDVLYLGFLADNHLINPAQITGEAPWAVALAGATYQGQLWAIPSWLCMDFFYAFDQAIQQQKTLSKMLNYLNTRTSSVAKMAGSFNGSWAIPSDYINAYVQTYGYGALQQAMQMPPDNGVVHQLVSLSDTCSFNGVNKCTNNTYHNAPNGGAEQVFASGQASTDMGFSEQSFYVNLYSSAQKPLYVVPTPWGEHPQPLLFEDAFVSSAATCKPGSQCAANAQAFTTLMTGTAMKNYIVQSKDLPAGTPWRTLLVATQQFWQQSIIANNSYYQQLSPIFMTAKAFPNNFTPQSQVAMANGICNALKQQQPNFVCKSNNSTSLLAPSHGSSIINPGSTDSRRGL

SEQ ID NO: 2631 - protein, 133 aa, Serratia sp.
MSIGPVSGNGITITLPVGKTLFWTANVQASYSQYVLVRDSTNQVVIESKGASTGGHSPTQIGQGSFVTAGSGVYTVFIGYNNGQSWSQVMWDEIALNIGSQIYSSCFNFISEDGADQDFNDTCLTLTWFNSIG

SEQ ID NO: 2632 - protein, 112 aa, Serratia sp.
MAIGHYELKKAKNGQYHFNLKASNGEIILGSEMYASKASAENGIASVQTNSPQEAQYELKHSTSNQPYFVLKAKNHQVIGVSEMYSSETAAKNGIQSVIKNGPSTDVRDLSA

SEQ ID NO: 2633 - protein, 159 aa, Serratia sp.
MKGDKKIIAHLNKLLGNELVAINQYFLHARMFKNWGLMRLNDKEYHESIDEMKHADRYIERILFLEGLPNLQDLGKLNIGEDIEEMLRSDLALELDGAKNLREAIAYADSIHDYVSRDLMIEILADEEGHIDWLETELDLIARLGIQNYAQAQVLERKD

SEQ ID NO: 2634 - protein, 660 aa, Serratia sp.
MTELTPGIAAPLGAHYDGNGINFTLFSAHATGVELCLFDGQQREVRLPLPARSGDIWHGYLPGGKPGQRYGYRVYGPFDPAQGLRFNPNKLLLDPAARAVEGPVADDLELHGGYDRPDPQDSAEVMPKCVVIDEAYDWQDDRPPATPWGKTVIYEAHVRGLTLLHPDIPPVLRGSFAALGHPVMIAHFKRLGITALELLPVQQHSSEPRLQRLGLINYWGYNVLAPYAPDNRYCSLRTDMTPLREFRDAVKALHKAGIEVILDVVFNHSAELDMDGPTLSLRGIDNPEYYWLTPDGEYVNDTGCGNTLRLDKPQGVAWVMECLRFWVSECHVDGFRFDLGSVLGRTPAFDRDAPLFQAMLADDLLSRCKLIAEPWDIGPGGYQVGAFPGRFAEWNDHYRDDMRRFWLQGDLPLGQFAQRFAGSSDLFNQRGRAPYAGINMLTAHDGFTLQDLVSFNRKHNQLNGEGNRDGSDHNFSYNHGVEGPIADDAIVQRRRASRQALLATLLLSQGTPMLLAGDEHGHSQQGNNNAYCQDNAITWLDWAKADDSLTAYTAALIHLRRQIPALQQDRWWQEGDGSVQWLNAQGLPPAAQEWEQGDLQLQIRLSQRWLVVVNATPQPVEMRLPAGDWQVVAPFTQEGSRAVLPAWNQAAHSICVLVQK

SEQ ID NO: 2635 - protein, 117 aa, Streptomyces sp.
MTSKLQNAARTVAASLAAAAAFTLFVPTGTAAAIDHVTCNPGAGYLKIWSHLNGRDSVDCYANRGKTNFGGWWVDKISTGNNDVKYYDANGDVVKINRHKVISFPNRPPKVKAIEIL

SEQ ID NO: 2636 - protein, 157 aa, Streptomyces sp.
MTERNRVPSLLSRAGAVSALSLAAMSTTLVAPGAAPEAAAATHAAKALQIASSKKGSPYRYGATGPRSFDCSGLTLYSYKKAGKKLPRTAAQQHNRTKRIAASNRRKGDLVFFHSGGSVYHVGIYAGGGKIWHSPKSGAVVRLEKIWTGSVRYGRVN

SEQ ID NO: 2637 - protein, 112 aa, Streptomyces sp.
MNTVRTTAMALAAATAFTLVGPAGSASAIDHVTCDPDRGYLKIWSHLNGRDSVDCYANRGKTNFGNWWVDKISTGNNVVKYYDANGDVVKIDRNKAISYPNRPPKVKAIEIL

SEQ ID NO: 2638 - protein, 110 aa, Streptomyces sp.
MRNRRNRRTLRSTVTATAVAGVLALGAGTAVASGFLSWEGPQNTGRAKELTRCGCSNIDPNFRAAYRFTYTGQTAAMYNQPDCAGTSHYTFRGNSESVQPFGWRSIFIHC

SEQ ID NO: 2639 - protein, 102 aa, Streptosporangium sp.
MKRIALVPVISAAMVAVMGSAAYASQYVAYEGPGFTGRSVVIDRCGPSNIPFHGSYKWYGDGQSGRMYNQPNTQGVTHFELPSNRNAEQRTPVGWKSIFIVC

SEQ ID NO: 2640 - protein, 398 aa, Curtobacterium sp.
MTTTPSTVARARRLPRIAGAVTALALAAGALVATAEPAAASAVWVGSAPAGTKILPGDQVTSPNGQFKLIMQGDGNLVEYGIGNRVLWASNTAGNSGAIAVVGKNRALDITKNGKRVARWASAGTVNSTALKVRADGTMALLAGKTVVVSWNGYQDRVPSGNTILGGTVLRSDTSNTRILNMRTDGNLVQKVSGRVVWQSRTGGHPGAWAELQAKGNFVIWTRDASRKKVALWSSRTSTAGSGNLLVQVDGNVVLYGAKDTRVWSSRPVTGLAWPVNGTKITGRYGDDRGAGHVPRYHQGTDAPVPVGTAVYGSGTGTVTKTIANDAAYGNYIVVTYGMTAVLVAHLSKIEVKQGQIVKLGTEIAKSGNTGQSTGPHVHVETRRNGTLVDPLKNMHFR

SEQ ID NO: 2641 - protein, 427 aa, Bacillus sp.
MVKQGDTLSAIASQYRTTVSEITETNEIPNPDSLVVGQTIVIPIAGQFYDVKRGDTLTSIARQFNTTAAELARVNRIQLNTVLQIGFRLYIPPAPKRDIESNAYLEPRGNQVSENLQQAAREASPYLTYLGAFSFQAQRNGTLVAPPLTNLRSITESQNTTLMMIITNLENQAFSDELGRILLNDETVKRRLLNEIVENAKRYGFRDIHFDFEYLRPQDREAYNQFLREARDLFHREGLEISTALAPKTSATQQGRWYEAHDYRAHGQIVDFVVLMTYEWGYSGGPPQAVSPIGPVRDVIEYALTEMPANKIVMGQNLYGYDWTLPYTAGGTPARAVSPQQAIVIADQNNASIQYDQTAQAPFFRYTDAENRRHEVWFEDARSIQAKFNLIKELNLRGISYWKLGLSFPQNWLLLSDQFNVVKKTFR

SEQ ID NO: 2642 - protein, 92 aa, Streptomyces sp.
MSILINRTNCNQNDYFEIHNNNGRDTLCFANAGSMPVAIYGVNWIESGNNVVTFEFQRNLSEPRLETVTLDKWRSWQPGQPSIHRVTWIRIH

SEQ ID NO: 2643 - protein, 326 aa, Alkanindiges sp.
MSNKGSFIALNQVLTTNDYLVSSNHAFFAIMQGDGNLCVYRGSALDANKGFLWGALGQSQPNGDYFSIMQGDGNLCVYKGTCPSDNKGFVWGALNQSQPNQAYFAVLQDDGNLCVYKGTNPSDNQGGVWCASAIDPVVDIEISSINYDVAAAKIIKSTPADLYRQSVTNNTAQSQTSSISGSESVSETSGWSDSLAVKVGVSTTFKTGIPFLAEGKITVSLDVTNTYTWNGSTTRTKTWSFNTPVTVPANSTYVALIAATVSTISVPYTLTGILILKSGARVPGIVNGMYTGSNSHDLTVTYITQNAVTLKIESVTQPVEHARLVA

SEQ ID NO: 2644 - protein, 471 aa, Streptomyces sp.
MTVSRARRRRRDLTLALAAVPALVLGALTAAPAHAAPADDIRVNEVVTTGSVEDSIELYNKGASTVDVSGWILKDDSNSSKYTIAAGTTLAPGAFRAFDVHGKFGLGSSDKARLYLPDGSTLVDSHTWSSHSAPSWSRCPDGTGAFKAAAVTLGAANSCGGGGGTGPVAWPGGSTVTTADAANVFGGDLSGLHQEGDVLWAAQNSGKLWRLVRNGSGGWTPDTANGWASGKTLRFPGGSGAPDGEGVTVTGAGAAAGVFVASERNGDASGTSRLSVLRYDVAGTGSTLTAAREWNLTADLPATGSNAGFEAITWVPDTALTAAGFKDSSTGAPYAPAGYGAHGGGVFFVGVEGTGAVPGYVLQDSGAFTRVASVSTGMAGVMEVQWEPQASRLWAVCDDTCGGQHRTLKVDASGAFAVAATYARPAGMPDLNNEGFALAGADECVAGSKPVYWSDDSNTGGHALRRSTVTC

SEQ ID NO: 2645 - protein, 472 aa, Streptomyces sp.
MTVSRVRRRRRDLPLALAAVPALLLGAVTAAPAQAAPADDVRVNEVVTTGSVEDSIELYNKGTSAVDVSGWILKDDDNGSKYTIAAGTTLAPGGFRAFDVHGKFGLGSSDKARLYLPDGSTLVDSHTWTSHSSPSWSRCPDGTGAFKAAAVTLGAANNCGGTGGGTGPVAWPGGSSVATADASNVFGGDLSGLHQEGNVLWAAQNSGKLWRLVRDGSGGWTPDTAGGWGSGKTLRFPGGSGTPDGEGVTVTGAGSAGGVFVASERNGDASGTSRLSVLRYDVSGTGSALTATREWNLTADLPSTGSNAGFEAVTWVPDTALTGAGFKDASTGAPYDPAGYGAHGGGVFFVGVEGTGALHGYVLRDSGAFTRVATVPTGMAGVMEVQWEPQASRLWAVCDDTCGGQHRTLKVDASGAFAVNAVYARPAGMADLNNEGFSLAGADECVAGTKPVYWSDDSNTGGHALRRGTVNC

SEQ ID NO: 2646 - protein, 476 aa, Kitasatospora sp.
MTEPRAPRWRRRLSLLLAAVALPAVGTGVLTASPAAAAPADDIRLNEVVTTGSVNDSIELYNKGTSTIDVSGWILKDDNDSSKYKIASGTSLAPGGFKAFDVHGSFGLGSADSARLYLADGVTLVDSFSWTSHSNPSWSRCADGTGGWTQAATLTLGAANNCGSSGGGSTTPVAWPGGSTVATADAANVFGTDLSGLYQEGGVMWGAQNSGKLWRLVPNGSGGWTPDTANGWGSGKALRFPGGTGTPDDEGVTLTGAGSAGGVYVSSERNADASSTSRLSVLRYDVSGTGSTLSATREWNLTADLPATGANLGLEGITWVPDSYLTGTGFKDAATGAAYDPSRYAAHTGGVFFVGVEGSGTVYGYVLLEAGGFTKVATVSSGMAGVMELQWEPQANRLWVVCDDTCSGQHRTFQVNASGAFAVTAVYNRPSGMPNINNEGFTPAGADECVGGSKPVYWSDDSNTGSHVLRKGSISC

SEQ ID NO: 2647 - protein, 472 aa, Kitasatospora sp.
MTASRAPRRRRSLALLLATALGPVLATGVLGASPAAAAPADDIRINEVVTTGSVNDSIELVNKGTAAVDISGWVLKDDNNSSSYKVAAGTTLAAGAFKAFDVHNAFGLGSADKARLYLPNGSTLVDSFTWSTHSAPSWSRCPDGTGAFAQAQLTLGAANSCGSGGGTPVAWPGSSSIATADASNVFGTDLSGLYQDGGVLWGAQNSGKLWRLLPDGSGGWTPDTASGWSSGKTLRFPGGTGSPDSEGVTVTSAGAAGGVFVSSERNGDASGTSRLSVLRYDVSGTGSTLTATKEWNLTASLPAVGSNLGLEGITWVPDSALTAAGFKDESTGAAYDPAGYAAHTGGVFFVGVEGTGAVHGFVLQDSGSFTKVASTSTGLAGVMEVQWEPQTSRLWVVCDDTCNGQHRTLKVNASGVFATTAVFNRPTGMSNLNNEGFAIAGAAECVGGSKPVYWSDDSNTGGHALRRGTVTC

SEQ ID NO: 2648 - protein, 474 aa, Streptomyces sp.
MPEVPAPRRRRRLAFLSAAVAGPTLVVGTVLAPSAHAAPADDIRINEVVTTGSVNDSIELYNEGPVAVDVSGWILKDDNDGSKYAIAAGTTLAPGAFRAFDVHNAFGLGSADKARLYLPDDTILVDSFGCSSHSNPSWSRCPDGTGAFGAAPVTLGTANACGGDNGGTTPAAWPGGSSVTTADAADVFGQDLSGLYQEKDVMWGAQNSGKLWRLVPDGSGGWKPDAANGWTAGKSLRFSGGSGTPDSEGVTLTGAGSPGGVFVASERNGDASGISRLSVLRYDVSGSGTTLAATREWNLTSDLPSVGSNLGFEGITWIPDTYLTSSGFKDESTGSAYDPNRYGGHTGGVFFVGVEGTGKVYGYVLQDSGAYTRVASIDSGMAGVMELQWEPQASRLWVVCDDTCDGQHRTMKVNASGTFATTAVYDRPSGMPNLNNEGFSVSGADACVSGSKPVYWADDSNDGGHALRKGSITC

SEQ ID NO: 2649 - protein, 462 aa, Kitasatospora sp.
MLLAAVALPAVGVGVLTAPPAAAAPADDVRINEVVTTGSVNDSIELYNKGAATIDLSGWILKDDNDSSKYKIASGTSLAPGGFKAFDVHGSFGLGSADSARLYLADGVTLVDSFSWSSHSNPSWSRCADGTGGWTQAATLTLGAANNCGSGSGGSTTPVAWPGGSTVATADAANVFGTDLSGLHQEGGVMWGAQNSGKLWRLVPNGSGGWTPDTANGWGSGKALRFPGGTGTPDDEGVTLTGAGSAGGVYVSSERNADSSSTSRLSVLRYDVSGSGSTLTATREWNLTADLPATGSNLGLEGVTWVPDSYLTGAGFKDASTGAAYDPSRYAAHTGGVFFVGVEGSGTVYGYVLLEAGGFTKVATVSSGLAGVMELQWEPQANRLWVVCDDTCSGQHRTFQVNASGAFAVTAVYNRPSGMPNINNEGFTLSGADECVGGSKPVYWSDDSNTSSHALRKGSISC

SEQ ID NO: 2650 - protein, 473 aa, Streptomyces sp.
MTASPSRPRRPRALARFLVATPLLAAGALTGVPAAQAAPADDVRINEVVTTGGVNDSVELYNKGTASVDVSGWVLKDDDKDHSYKIASGTTLAPGGFRAFDVSGAFGLGSADEARLYLADGKTQVDGFSWSKHSDPSWSRCADGTGAFKQAASVTLGAANACGGGGGGDSTTPAAWPGGSAVATADGSNVFGEDLSGLYQDGSVLWAAQNSGKLWRLVRDGSGAWKPDTANGWSSGKTLRFPGGSGSPDSEGVTATGGGIFVASERNGDASGTSRLSVLRYDVSGSGSSLTAAKEWNLTSDIPSTGSNLGLEAVTWIPDAALTSAGFKDASTGAAYDPSRYAAHSGGVFLVGVEGTGMVYGYVLADSGSYTRVASFSSGMSGVMELQWEPQASRLWAVCDDTCDGRHRTLKVDAAGTFAAVAVYNRPSGMPNYNNEGFALAGADECVAGSKPVYWSDDANDGGHALRRGSVSC

SEQ ID NO: 2651 - protein, 469 aa, Streptomyces sp.
MTASTARRRPRALARILVAAPLLAACGLTGAPAAHAAGADDVRINEVVTNGDVNDSIELYNKGGAAVDVSGWVLRDDDKDHAYKIASGTTLAPGGFRAFDVSGAFGLGSDDEARLYLADGKTQVDGFSWSKHSGPSWSRCPDGTGAFEQAGSVTLGGPNACGGGGSTTPVAWPGSGDVATADGSNVFGEDLSGLYQEGDVLWAAQNSGKLWRLVRDGSGGWKPDTANGWSSGRTLRFPGGSGSPDSEGVTATGGGVFVASERNGDASGTSRLSVLKYDVGGSGSSLTAAKEWNLTSDLPSTGSNLGLEAITWVPDASLTGAGFKDASTGSAYDPSRYGAHSGGVFFVGVEGTGMVHGYVLADSGSYTRVASFGSGMSGVMELQWEPQASRLWAVCDDTCDGRHTTLKIDTTGAFTTVAAYNRPSGMPNYNNEGFALAGADECLAGSKPVYWSDDANDGGHALRRGRVSC

SEQ ID NO: 2652 - protein, 116 aa, Amycolatopsis sp.
MRKSLKRLSVVGAAALGLLVAVPASPAFAIGEVACGNRDDFVKLDISFGNGMGTNKCFANGGVTGTNIGGVYNVFSGNNKVTVNYERNGRYESSTLGYWQGVGFSGTVRVYEVRIW

SEQ ID NO: 2653 - protein, 116 aa, Amycolatopsis sp.
MRKSLKRLSVVGAAALGLLVAIPASPAFAIGEVACGNRDDFVKLDISFGNGMGTNRCFANAGVTGTNIGGVYNVFSGNNKVTVNYERDGRYESSTLGYWQGVGFAGTVRVYEVRIW

SEQ ID NO: 2654 - protein, 131 aa, Amycolatopsis sp.
MTVLTVITTHDQPRPILGASALLAVVGATALGLVAAVPATPAFAIGEVACGNRDDFVKLDISFGNGMGTNRCFANAGVTGTNIRGVYNVFSGNNKVTVNYERNGRYETSTLGYWQGVGFAGTVRVYEVRIW

SEQ ID NO: 2655 - protein, 117 aa, Amycolatopsis sp.
MISSKKTAGRVMAVAAAAAATFTMVVPTGTSFAIDHIPCRAGESFLKIWSHLGGRDSVDCYANRGKIGFGGWWVDKIETGNNDLIYSDANGDSVRVNRWTIITYPNRPPRVNYIEIL

SEQ ID NO: 2656 - protein, 117 aa, Amycolatopsis sp.
MISSKKAARRVLAAAAAAAAAFSMLVPTGTSFAIDHIPCRDGENFLKIWSHLGGSTSVDCYANRGRIGFGGWWIDRIYTGNNDLIYYDSNGADVRINRWTDISFPNRPPKVRVIEIL

SEQ ID NO: 2657 - protein, 117 aa, Streptomyces sp.
MNQKTKKAVRSTVVAFAAATALAATLPTGNAYAIDHIPCRAGENYLKIWSHLNGKDSVDCYANKGKISFGNWWVDRISTGNNDLIYSDANGDSVRVNRWTDITYPNRPPKVSYIEIL

SEQ ID NO: 2658 - protein, 118 aa, Streptomyces sp.
MFSNARKAVGSMAAAFAAAATLTVAVPSGSAFAIDHIPCDGSRNDFLKIWSHLDGRDSVDCYANGGSIGFGGWWVDRISTGNNDLVYSDDNGDSVRVNRWTDISYPNRPPKVNSIRIL

SEQ ID NO: 2659 - protein, 117 aa, Streptomyces sp.
MLSKTKKVGRSVAVAFAAAAMFTVTVPTGNAFAINKVECRGGENFLKIWSHSGNRHSVDCYANRGRMSFGSWWVDRIYTGNNDLIYYDANGDSVRVNRWTDISYPNRPPKVKDIEIL

SEQ ID NO: 2660 - protein, 117 aa, Streptomyces sp.
MISHAKRVARSVTVAFAAAAAFTMTVPSGNAFAIDHVQCRGGENFLKIWSHSGGRQSVDCYANRGKTSFGGWWVDKISTGNNDLIYYDANGDSVKIERWREITFPNRPPKVNAIEIL

SEQ ID NO: 2661 - protein, 117 aa, Amycolatopsis sp.
MISTKKTARRVLAAAAAAAAAFSLLVPTGTSFAIDHIPCRDGENFLKIWSHLGGSSSVDCYANRGRISFGDWWIDRIYTGNNDLIYYDSNGSDVRINRWTDISFPNRPPKVRVIEIL

SEQ ID NO: 2662 - protein, 117 aa, Amycolatopsis sp.
MISSKKKARRILAAAAAAAAAFSLLVPTGTSFAIDHIPCRDGENFLKIWSHLGGSTSVDCYANRGRIGFGGWWIDRIYTGNNDLIYYDSNGADVRINRWTDISFPNRPPKVRVIEIL

SEQ ID NO: 2663 - protein, 117 aa, Streptomyces sp.
MFSKTKKLMSVGAATFAAAAAFTVAVPSGSAFAIDHVECRGGENFLKIWSHNGGIQSVDCYANAGRTDFGNWWVDRISTGNNDLIYYDANGDSIRINRWTDISFPNRPPQVKSIEIL

SEQ ID NO: 2664 - protein, 191 aa, Arthrobacter sp.
LPWVAPTMKKLSIWLAAILMAVGLGILVPGPASATTSYCGLVWGSLAETDQRFSKTTVTNVRTGQHYCFDRMVLDLKGPATGYNVRYVPRVVQDGSGFTVPVRGGARLQVTLHAPSYDPYSGEPTYNPPANQAELSNVANYQTFRQVAWAGSYEGYTNIGLGVRARLPFRVFTLDGPGSNSRLVIDVAHFW

SEQ ID NO: 2665 - protein, 183 aa, Arthrobacter sp.
MKKFSTWLAAILLAAGLGIAVPGQASATTSYCGLVWGSLAKTDGTLAAASVTNVRTGRHYCFDRMVVDLSGPAVGYLVRYVPKVVEDGSGFTVPVRGGARLQVTVKAPAYDPNTGQPTYTPANRAELSNVAGYQTFRQVAWAGSFEGQTNIGLGVRARLPFRVFTLDGPGSGSRLVVDVAHYW

SEQ ID NO: 2666 - protein, 171 aa, Arthrobacter sp.
MAVGLGILVPGPASATTSYCGLVWGSLAKAEDSFGKASVTNVRTGQHYCFDRLVVDLNGPETGYNVRYVANVVQDGSGFTVPVRGGARLQVTVNAPAYDPETGQPTYNPANQAELTNVANYQTFRQVAWAGSYEGYTNLGLGVRARLPFRVFTLDGPGSGSRLVVDVAHFW

SEQ ID NO: 2667 - protein, 187 aa, unknown
  environmental sample
MGGPTMKKFSTWLAAILMAAGLGIVAPGPASATTSYCGLVWGSLAKADQDMSTANVTKVRTGQHYCFDRMVVDLNGPAAGYTVRYVPQIVQDGSGFTIPVRGSGRLQVTVNAPAYDGNGNSTYTPADPAELSNVAGYQTFRQMVWAGSYEGYTSIGLGVRARLPFRVFTLDGPGSGSRLVVDVAHYW

SEQ ID NO: 2668 - protein, 183 aa, Arthrobacter sp.
MKKLSIWFTAILVAVGLGLLVPGPASATTSYCGLTWGSLLKTDDSMSGAPVTNVRTGQHYCFDRLVVDLGSGPVPGYYVRYVGQVTQDGSGKPVDVRGGARLQVVVRAPAYNDSGNATYTPSDQAELSNVSGYQTFRQVVWAGSFEGQSTLGVGVRARLPFRVFTLDGPGSGSRLVVDVAHFW

SEQ ID NO: 2669 - protein, 181 aa, Arthrobacter sp.
MKKLLLWLTALLAAVGLGILAPGPASAATSYCGLAWGSQDKTAPEMSSASVTNVRTGQQPCFDRMVVDLNGPVKGYTVRYVPEIIQDGTGFTIPVYGNARLQVVVNAPSYDSNGVTYNPAAKAELSNVAGYQTFRQVVYANSFEGSTSIGLGVRARLPFRVFTLDGPGSGSRLIVDVAHFW

SEQ ID NO: 2670 - protein, 181 aa, Arthrobacter sp.
MKKFLTWLAAILLASGLGIVVQAPASAAPYCGLTWGSLAKTGQDTGTASVTNVRTGQHYCFDRLVVDLNGPAVSYTVQYVPRIEQEGSGAFIPVRGGARLHISIKAPSYDQNGNPTYNPADKAELSNVAGYQTFRQVVSAGSFEGYTSLGLGVRARLPFRVFTLAGPGPGSRLVIDVAHYW

SEQ ID NO: 2671 - protein, 261 aa, Arthrobacter sp.
MRSARPLIFFLSVTASASLCLSGCMVNASAENRDTGTAPATQPPSASAPPANPSAKPTTTETLPPPTTAPAEPLPSAVPPSSSSDPAPAADPVTFTFADGRLSFTHPAGWRVEHSQTVASPSVQNATVYDTSGNEQIGIFYSEVGGGVAGPHTRTVFFSEPVPGLQGHSGPASGPATAHVSFYVDHIYGEPHYSLSLTHREALSPDGTEGADVVIVGGNRVLAANVVFTGGPFASDEAAKAWFAGTEGQALKAILMSFSYR

SEQ ID NO: 2672 - protein, 257 aa, Arthrobacter sp.
MHSARRLIFFLSVTASASLCLSGCMVNASAENRDTGTAPATQPPSASAPPATPSAKLTTTAAPPPPTTAPAEPLPTSAPPSSSSDPAPAAEPVTFTFADGRLSFTHPAGWRVEHSQTVASPSVENATVYDTSGNEQIGIFYSEVGGGVAGPHTRTVFFSEPVPGLQGHSGPATAHVSFYVDHIYGEPHYSLSLTHREALSPDGTEGADVVIVGGNHVLAANVVFTGGPFASDEAAKAWFAGTEGQALKAILMSFSYR

SEQ ID NO: 2673 - protein, 181 aa, Arthrobacter sp.
MRKIGAGLAAVLAAAGLGLAAPGPASAASYCGLVWGSLAKADPDMSSANVTNVRTGQQPCFDRLVIDMTGKVAGYSVRYVPVVTQDATGYPIPVIGDADLQVVVTAPSYNQYSQPTYLPAAKAELSDVSGYQTFRQVVYAGSFEGTTSIGLGVRARLPFRVLTLDGPDGGSRLVVDVAHHW

SEQ ID NO: 2674 - protein, 181 aa, Arthrobacter sp.
MRKLGAGLTAVMAAAGLGLVAPGPASAATYCGISWGSMAKADLDWSSANVTNVRTGQQPCYDRLVIDMTGKVAGYVVQYVPVVTQDATGYPIPVLGDADLQVMVTAPSYNQNNQPTYVPAAKAELSNVSGYQTFRQVVYAGSFEGTTSIGLGVRARLPFRVFTLDGPDGGSRLVVDVAHRW

SEQ ID NO: 2675 - protein, 1031 aa, unknown
  environmental sample
MEQSTARQFSQRLLRGRKLTTVVAAAALAVAGMTAVVSSTPAYADQQRQVVGTGLTKPAGTVVDPVGKVWVSDSVAGFCRMSDPANGQPGTVEKDTCLGGSLAGAGQGPKVPGVATVLDPTPSSAGSGDETAFIPDSSVGSSHVVRAVWSPAQDLFEYSSTLTILDGDVRPNAASDGPDGNIYLSFANARSIIKIVDPTIKHPSIESIASVTTKALGLVAAGWDSNGHVSVYVLETTGLRAFSAPDDGDMTNYVPLASYNVGVASSIYYDYDAHIIYTGTSSGTTTADAGKDKVSRLNLGTGAVDNSWALGFSKISGLGMRGGQLLVLDDAGQLNNPPATGQGKMSLLGGVAAQITSGPTLANGTQSPNTAFTNDTTPTFGVSADPAGSALECSVGGAWTDCTSGTYTSAVLANGPQTFSVRPAPGGVPVSRTFTVDTVAPAAPVFTAPNSGQVVNGKPVLGATFEPGTTLSCSVDSTADAAFKACVPGDTFTLTTEGAHTLRIRSTDPAGNVGPAAALTVTADLTAPQVAITAPASGATVGAGYQFQFASSSPDVAGFRCRLGTDAFTECTSPKVYADIANGANRFEVEARDTAGNTTVAGVNFTVFVADTTPPTVTADPVGGTYGPSSKVTLTASEADAKIYYTEDGSTPTTASTLYTAPIAMGSKTLKYIAVDAANNASAPQTQVYVLDNAAPAVTPNPSGGNLALGQSVTLTTESGAKIYYTTDGTTPTVASQAGTTTVTITPTATTTVKYFAVDAAGNQSAVASQTYTLPAAPANTWKDYNSDAKNDVLARDSAGTLWLYPGNGTGGWLGKVNTGTAWNNYNLIVPTRDFSGDGRSDVLARDAAGQLWLFKGNGTGGWQPAVSVGSGWSGMTAIVAPGDFNGDGKSDVLARDAAGVLWLYKGDGLGKFAAGATQVGAGWNVMNAIFSTGDFNGDAKTDVIARDTSGGLWLYPGNGTGGWGTRTQIGSGWGGMTALLGPGDFNGNGKSDVLARDASGNLWLYPGNGTGGWLAWGQVGTGWQGFTSLP

SEQ ID NO: 2676 - protein, 1027 aa, Arthrobacter sp.
MEQQTTHDAGWRLRGHKVITVLAAVLLTVAGMTAVVSSTPAHADQQKQIIGIGLTKPAGTVLDPIGRMWVSDSVAGFCRMSEPVNGNAGTIEQDTCLGGTSPDAGPGPKVPGVSVVLDPTPGSIGSGDETAFIPDSAVGSSHLVRAAWNPPLDLFEYSSTLTVLDGDVRPNAVSDGPDGNIYLSFANARSIIKIVDPTIMHPSIESIASVTTRALGLVAAGWDNNGYVSVYVLETTGLRAFSAPGNGEMTDYVPLTSYNVGVAASIFYDYDAHVIYTGTSSGTTAGTDKVSRLNLSTGAVDNQWALGFSKISGLGMRGGQLLVLDDPGQLGTTPATGRGSISLLGGAVAKITSGPTLANGAQAPNPEFTNDTTPTFVVTAEPAGSALECSMGGTWADCTGGTYTSAALLNGLQTFSVRPAPGGVPVSRTFTVDNVAPAAPVFTAPNSGQVVNGKPVLGATFEPGTTLSCSVDSTADAAFQACVPGDTFTLTTAGAHTLRIRSTDSAGNVSPAAAQTVTADLTAPQVAITAPASGATVGAGYQFQFNSTSSDVAGFRCRLGTDAFTACTSPKVYADIANGPKRFEVEARDGAGNTTVAGVNFTVFVADTTPPTVTASPVGGTYGPATKVTLTANEADAKIYYTENGTTPTAASTLYTGPITMGSKTIKYIAVDAANNASAPQSQVYVLDNVAPTVTASPLGGNLTLGQKITLTTESGAKIYYTTNNSTPTVSSPSGTTTVTVTPAATTTVKYFAVDAAGNQSAVASQTYTLPAAPTNTWKDYNSDAKNDVLARDAAGTLWLYPGNGTGGWLGKVNTGTSWNNYNLIVPTRDFSGDGRSDVLARDASGQILLFKGNGAGGWQPPEVVGSGWSGFTAVAAPGDFSGDGKSDVLARDASGVLWLYKGDGTGKFSAGRTQVGAGWNVMNAIFSTGDFNGDSKTDVLARDTGGALWLYPGNGSSGWGTRSQIGSGWNGMTALLGPGDFNGNGKADVLARDASGNLWLYPGNGSGGWLAWGQVGNGWQGFTSLP

SEQ ID NO: 2677 - protein, 910 aa, Multievos46 sp.
MQIVAHTDDDLIFISPDFMRDIQSKRCVQTVYATAGEAGEGAAYWNSLEAGIRASYAKMAGVADAWTTSDAGVPGRPLTLQTLNAAPNVSVVFMRLPDGFPDGRGSSRYNGQSILKLWDGRLSSIRPVDGAAAFTKAQFQTTLNQLVANYQPTTFRTQDWTGNYQDPYDHSDHWATAKFAQLASRAYTGPHTASAYDAYVIDEYAQNVTGADLTNKVNTFVRFADFDKYLCDTPCPAPPYSDWLKRQYITAIEWTGNAAKSAGTTVSASSQKASGQSPEKARDGYAWGTPMDANREWVTNGGKAGSWIQYNFSPARTINAVTLFDRPILSDQVTGGNLAFPDGSTVPVGALPNNGSGLTVNFPARTVSSVRFNITSVSGSTTNVGLSEFEAHITADVVAPEVTATPPGGTYDIGQKVTLSANEPATIFYTLDGTTPTTASAKYATPITVNGPLTLKYFAVDAANNPSAVVTQSYSTGPDVTKPVVTANPLGGAYAPGTSITLTSNEANSVIKYTKDSSDPLTAGLVYSTPIVFAGPDPMTLKFFATDPAGNVSDVVTQTYNVPPDTRAPVVTANPTSRALASGATITLSADEPGASIYYTTDGSSPTATESASNFKYSAPLVMGTSQLTLKYVGVDAAGNTSPIGTQTYSVPAAGPPSSHDFNGDGKADVLSSDTAGNLYLYPGNGGGGLGPRQTALAAPAWSTITDTITPGDFNRDGKPDLLARAGDVLWFYPGDGAGSFGARVQVSTGWSTMSQLFSPGDFSGDGIPDLIARRSTGDLRLYEGNGSGGLRTPITIGTGWNVMNAILSTGDFNGDGTGDVLARRSDTGALWLYPGDGTRGWLAWKQISAGWDNRTSIAGPRDLDGDNKNDVIGRIGDTLWLYPGSGNGTLSNVPPTSLGTGWQAMKIIG

SEQ ID NO: 2678 - protein, 910 aa, unknown
  environmental sample
MQIVAHTDDDLIFISPDFMRDIQSKRCVQTVYTTAGEAGEGAAYWNSLEAGIRASYAKMAGVADAWTTSDAGVPGRPLTLQTLNAAPNVSVVFMRLPDGFPDGKGSSRYNGQSILKLWDGRLSSIRPVDGAAAFTKAQFQTTLNQLVANYQPTTFRTQDWTGSYQDPYDHSDHWATAKFAQLASRAYTSPHTASAYDAYVIDEYAQNVTGADLTNKVNTFVRFADFDKYLCDTPCPAPPYSDWLKRQYITAIEWTGNAAKSAGTTVSASSQKASAQSPEKARDGYAWGSPMDANREWVSNGGKAGSWIQYNFSPARTINAVTLFDRPVLSDQVTGGNLAFSDGSTVPVGALPNNGSGLTVNFPARTVSSVRFNISSVSSSTTNVGLSEFEAYITADVVAPEVTATPPGGTYDVGQKVTLSANEPATIYYTLDGTTPTTASAKYATPITVNGPLTLKYFAVDAANNPSAVVTQSYSTGPDVTKPVVSANPAGGAYAPGTTITLTSNEANSVIKYTKDGSDPLTAGLVYSTPIVFAGPDPMTLKFFATDPAGNVSDVLTQSYNVPPDTRAPVVTANPTSRALANGATITLSSDEPGASIFYTTDGSTPTATESATNFKYSAPIVMGTSQLTLKYIAVDTAGNTSPVGTQTYSVPAAGPPSSHDFNGDGKADVLSSDTAGNLYLYPGSGGGSLGPRQTALAAPAWSTITDTITPGDFNRDGKPDVLARDGDVLWFYPGDGAGSFGTRVQVSTGWSTMSQLFSPGDFSGDGIPDLIARRSGGDLRLYEGNGSGGLRTPTTIGTGWNVMNAILSTGDFNGDGTGDVLARRSDTGALWLYPGDGTRGWLQWKQISAGWDNRTSIAGPRDLDGDGKNDVIGRIGDTLWLYPGSGSGTFSSVPPTSLGTGWQAMKFIG

SEQ ID NO: 2679 - protein, 972 aa, Arthrobacter sp.
MVVDRPKYARRPTRLQLITTRSLARRILGFLLGLSVALSSLVFGAALPASAAVPPCPGTGGAQMIVAHTDDDLIFISPDFMRDIQAKRCVQTIYVTAGEAGEGQSYWGGLEDGIRSSYAMMAGVANAWTASDAGVPERPLTVHTLNAAPNVSVVFLRLPDGFPNGNGTTRYNGQSILKLWDGRISTIRPVDGSATYTKAQLQSVLNRLVANFKPTTFRTQDWTGNFTTPYDHSDHWAAAKFGQLATRAYTGPHTSSAYDAYVIDEYAQNVTGTDLTNKVNTFRRFAEFDEYLCGDICPDTPYSDWLKRQYITAIEWTGNAAKSAGTTVSASSQKASGQSPEKVRDGYAWGTPMDANREWVSNGGKAGSWIQYNFSPARTINAVTLSDRPLPSDQVTGGNLVFSDGTTVPVAALPNNGSGLTVNFPARTVSSVRFNITSVSGTTTNVGLAEFEAHITADVIAPVVTATPTGGTYDVGQKVTLAANEPATIYYTVDGSTPTTASSKYATPLTVNGPLTVKYFAVDTANNPSAVVTQVYSTGPDVTKPVVTANPAGGAYAPGTAITLTVNETNSVIKYTKDGSDPLTAGVVYSAPIPFEGPGPMTLKYSATDPAGNVSDVVTQTYTVPPDTTAPVVTANPTSRALASGATITLSVNEPGAAIYYTTNGSKPTATESATNIKYSAPVSMGTSTLNLKYIGVDTAGNTSAVGTQTYTVPAAGPPSAHDFNGDGKADVLASDTAGNLYLYPGDGAGGLLTRQVALAAPAWSTVNETITPGDFNKDGKPDLLARAGDVLWFYPGDGAGSFGARVQVSTGWSTMSQLFSPGDFSGDGIPDIIARRSTGELRLYEGNGTGGQRTPTTIGTGWNVMNAILSTGDFNGDGKADVLARRADTGALWLYPGDGTRGWLQWKQISTGWDNRTSIAGPRDLSGDGSNDVIGRIGDTLWLYPGTGSGAFSTAPPISLGTGWQALKIIT

SEQ ID NO: 2680 - protein, 972 aa, Arthrobacter sp.
MVVDRPKYARRHTRLSFFGTRSLVRRILGFLLGLCLALSSFIFGFAQPASAAVPPCPGTGGAQQIVAHTDDDLIFISPDFMRDVQAKRCVQTIYLTAGDAGEGQSYWAGLEAGIRSSYALMAGVANAWTASDAGVPERPVTVHTLNAAPNISVVFLRLPDGFPNGNGSTRFNGQSILKLWDGRISSIRPVDGSATYSKSLLQTVLNRLVANYKPTTFRTQDWTGNFTTPYDHSDHWAAAKFGQLATRAYTGPHTSSAYDAYVIDEYAQNVTGAELTSKVNTFRHFAEFDEFLCGAICPDTPYSDWLKRQYITAIEWTGNAAKSAGTTVSASSQRASAQSPEKARDGYAWGTPMDANREWVTNGGRAGSWLQYSFSPAKTINAVTLFDRPITSDHVTGGNLVFSDGSTVPVAALPNNGSGLTVNFPARTVSSVRFNISSVSGSTTNVGLAEFEAHITADIVAPVVTATPAGGTYDIGQKVTLTANEPATIYYTVDGSTPTVASSKYATPITVNGPLTLKYFAVDSANNPSAVVTQTYSTGPDVTKPVVTANPAGGAYAPGTTITLTVNEANSVIKYTTDGTDPLTAGQVYSTPIAFPGTAPMTLKYFATDPAGNVSDVVTQTYTVPPDTTAPVVTANPTSRALANGATITLSANEPGAAIYYTTDGSTPTATESATNIKYSAPIVMGTSNLVLKYIGVDTAGNTSAVGTQTYTVPAAGPPSAHDYNGDGKADVLASDTAGNLYLYPGDGAGGLLPRQVALPAPAWSTVTDTITPGDFNRDGKPDLLARAGDVLWFYPGDGAGSFGARVQVSTGWSTMSQLFSPGDFSGDGIPDFIGRLSSGELRLYEGNGTGGQRTPVTIGSGWNVMNAIFSTGDFNGDGKGDVLARRSDTGALWLYPGNGTRGWLPWKQISTGWDNRTSMAGPRDLNGDGSNDVIGRIADTLWLYPGTGSGVFSTVPPISLGTGWQAMKIIA

SEQ ID NO: 2681 - protein, 972 aa, Arthrobacter sp.
MVVDRPKYARRHTRPSLISTRSLARRILGFLLGLSVALSSFVFGFATPASAAVPPCPGTGGAQQIVAHTDDDLIFISPDFMRDVQAKRCVQTIYLTAGDAGEGQSYWAGLEDGIRSSYALMAGVANAWTASDAGVPERPVTVHTLNAAPNISVVFLRLPDGFPNGNGSSRFNGQSILKLWDGRISSIRPVDGSATYSKSLLQTVLNRLVANYKPTTFRTQDWTGNFTTPYDHSDHWAAAKFGQLATRAYTGPHTSSAYDAYVIDEYAQNVTGAELTSKVNTFRHFAEFDEFLCGNICPDVPYSDWLKRQYITAIEWTGNAAKSAGTTVSASSQRASGQSPEKARDGYAWGTPMDANREWVTNGGKAGSWIQYNFSPARTINAVTLFDRPLPSDHVTGGNLVFSDGSTVPVTALPNNGSGLTVNFPARTVSSVRFNISSVSGTTTNVGLSEFEAHITADVVAPVVTATPAGGTYDIGQKVTLTVNEPASIYYTVDGSTPTVASSTYATPITVNGPLTLKYFAVDSANNPSAVVTQTYSTGPDVTKPVVTANPAGGAYAPGTTITLTVNEANSVIKYTTDGTDPLTAGQVYSTPIAFPGTAPMTLKYFATDPAGNVSDVVTQTYTVPPDTTAPTVTANPTGRALASGATITLSANEPGAAIYYTTDGSTPTATESATNIKYAAPIVMGSSNLVLKYIGVDTSGNTSTVGSQTYTVPAAGPPSAHDFNGDGKADVLASDTAGNLYLYPGDGAGGVLTRQVALAAPAWSTVNEAITPGDFNRDGKPDLLARAGDVLWFYPGDGVGSFGARVQVSTGWSTMSQLFSPGDFSGDGIPDFIGRLSSGELRLYEGNGTGGQRTPTTIGTGWNVMNAILSTGDFNGDGKGDVLARRSDTGALWLYPGNGTRGWLQWKQISTGWDNRTSIAGPRDLNGDGSNDVVGRIGDTLWLYPGTGSGAFSTVPPISLGTGWQALKIIA

SEQ ID NO: 2682 - protein, 972 aa, Arthrobacter sp.
MVVDRPKYARRHTRPSVISTRSLARRILGFLLGLSVALSSFVFGFATPASAAVPPCPGTGGAQQIVAHTDDDLIFISPDFMRDVQAKRCVQTIYLTAGDAGEGQSYWAGLEDGIRSSYALMAGVANAWTASDAGVPERPVTVHTLNAAPNISVVFLRLPDGFPNGNGSSRFNGQSILKLWDGRISSIRPVDGSATYSKSLLQTVLNRLVANYKPTTFRTQDWTGNFTTPYDHSDHWAAAKFGQLATRAYTGPHTSSAYDAYVIDEYAQNVTGAELTSKVNTFRHFAEFDEFLCGNICPDVPYSDWLKRQYITAIEWTGNAAKSAGTTVSASSQRASGQSPEKARDGYAWGTPMDANREWVTNGGKAGSWIQYNFSPARTINAVTLFDRPLPSDHVTGGNLVFSDGSTVPVTALPNNGSGLTVNFPAKTVSSVRFTISSVSGTTTNVGLSEFEAHITADVVAPVVTATPAGGTYDIGQKVTLTVNEPASIYYTVDGSTPTVASSKYATPITVNGPLTLKYFAVDSANNPSAVVTQTYSTGPDVTKPVVTANPAGGAYAPGTTITLTVNEANSVIKYTTDGTDPLTAGQVYSTPIAFPGTAPMTLKYFATDPAGNVSDVVTQTYTVPPDTTAPTVTANPTGRALASGATITLSANEPGAAIYYTTDGSTPTATESATNIKYAAPIVMGSSNLVLKYIGVDTSGNTSTVGSQTYTVPAAGPPSAHDFNGDGKADVLASDTAGNLYLYPGDGAGGVLTRQVALAAPAWSTVNEAITPGDFNRDGKPDLLARAGDVLWFYPGDGVGSFGARVQVSTGWSTMSQLFSPGDFSGDGIPDFIGRLSSGELRLYEGNGTGGQRTPTTIGTGWNVMNAILSTGDFNGDGKGDVLARRSDTGALWLYPGNGTRGWLQWKQISTGWDNRTSIAGPRDLNGDGSNDVVGRIGDTLWLYPGTGSGAFSTVPPISLGTGWQALKIIA

SEQ ID NO: 2683 - protein, 947 aa, Arthrobacter sp.
MLGMVLSPALAFGGLVLASAAPASAAVPPCAGTGGAMQIVGHTDDDLIFLSPDFMRDIQAKRCVQTVFTTAGEAGEGATYWRSLEAGIRASYAKMAGVADSWTTSDAGVPNRPLTMQTLNGAPNISVVFMRLPDGFPNGLGSAAYNSQSILKLWDGRLSSIRPVDNAATFTKSQFQTALNRLVANFKPTTFRTQDWTGNFNSPYDHSDHWATAKFAQLATRSYTGPHTSMAYDAYVIDEYPQNVTGSELTAKVDTFVRFADFDMYLCNSPGEGCPDSPYNEWLKRQYITAIEWVGNAAKSTGTTVSASSQKASAQSPEKARDGYFWGAPMDASREWVSAGEKAGSWIQYNFTPTRTINAVTLGDRPILSDQVTGGNLVFSDGSTVPVPALPNNGSGLTINFPAKTVSSVRFNITSVSGSTTNAGLAEFEAYLGTDNVAPVVTAAPEGGTYAAGQAITLTANETATIYYTTNGSTPTTASTKYTAPIILNGPLTLKYFAVDGANNSSAVVTQTYSTGPDVTKPIVTANPASGEYAAGTNITLTANEAAEIRYTKDGTDPLTAGLLYTAPITFTGPGPMTLKYFAKDTAGNTSDVATQTYTIPPDTTAPVITANPTGRALANGATITLSANETATIYYTTDGSTPTTTDSATNLKYTVPLVMGNSTLTLKYIGVDAEGNTSTVGTQTYTVPAAGPPSTHDFSGDGRSDVLAADTAGNLYLYPGDGAGGLLPRQVALAAPAWSSVTDTITPGDFNRDGKNDLLARAGDILYFYPGDGAGSFGARKQVSTGWTTMSQIFSPGDFSGDGIPDFIGRRSNGELRLYEGNGSGGQRSPYTVGWGWDVMNAIFSTGDFNGDGKGDVLARRTDTGALWLYPGNGSGGWLTWKQIATGWSTRTALAGPRDLDGDGKNDVLGRIGDTLWLYPGSGGGTLGNVPPISLGTGWQGMKVIA

SEQ ID NO: 2684 - protein, 965 aa, Arthrobacter sp.
MVRSHVSNRTNPPVSRPALLRRVLGAILSPALAFGGLVLAAAAPASAAVPPCAGTGGAMQIVAHTDDDLIFLSPDFMRDIQAKRCVQTVFTTAGEAGEGATYWRSLEAGIRASYAKMAGVADSWTTSDAGVPNRPLTMQTLNGAPNISVVFMRLPDGFPNGDGSAAYRDQSILKLWDGRLSSIRPVDNAATFTKSQFQTALNRLVANFQPTTFRTQDWTGNFNSPYDHSDHWATAKFAQLATRSYSGPHTSSAYDAYVIDEYPQNVTGSELTAKVDTFVRFADFDMYICSSPGEGCPDSPYNEWLKRQYITAIEWVGNAAKSTGTTVSASSQKASAQSPEKARDGYAWGAPMDATREWVTAGEKAGSWIQYNFTPTRTINSVTLFDRPILTDQVTGGNLVFSDGSTVPVPALPNNGSGLTINFPAKTVSSVRFNITSVSGSTTNAGLAEFEAYLGTDNVAPVVTAAPQGGTYAAGQAITLTANETATIYYTTNGSTPTTASTKYTAPIILNGPMTLKYFAVDSANNSSAVATQTYSTGPDVTKPVVTANPASGEYATGTNITLSANEPAEIRYTKDGTDPLTAGLPYTAPITFTGPGPMTLKYFAKDTAGNTSEVATQTYTAPPDTSAPVITANPSGRALASGATITLSANEAATIYYTTDGSTPTTSSTKYTDPIVMGSSTLTLKYIGVDGAGNTSAVGTQTYTVPAAGPPSSHDFNGDGRSDVLAADTAGNLYLYPGDGAGGLLPRQLALAAPAWSSITDTITPGDFNRDGKNDLLARAGDILYFYPGDGAGSFGARKQVSTGWTTMTQIFSPGDFSGDGIPDFIGRRSNGELRLYEGNGSGGQRSPYTVGWGWDVMNAIFSTGDFNGDGKADVLARRTDTGALWLYPGNGSGGWLTWKQIATGWSTRTALAGPRDLDGDGKNDVLGRIGDTLWLYPGSGGGTLGNVPPTSLGTGWQGMKVIA

SEQ ID NO: 2685 - protein, 971 aa, Arthrobacter sp.
MDRPKYASRPLRTTIRTSFHRWVLGFLLGPAMVMGSLVLTTASVATAAEPPCAGTGGAMQIVAHTDDDLLFLSPDFMRDIQAKRCVQTVFTTAGEAGEGATYWRSLESGIQASYAKMAGVSNSWTTSDAGVPGRPLTMRTLNGAPNVSVVYMRLPDGFPNGLGSAAYNSQSILKLWDGRLSSIRPVDNAATFTKSQFQSALNRLVANFQPTTFRTQDWTGNFNSPYDHSDHWATAKFAQLATRSYTGPHTSLAYDAYVIDEYAQNVTGAELTAKVDTFVRFSDFDMYICSTPGEGCPDSPYDEWLKRQYITAIEWVGNAAKSAGTTVTASSQKAAAQSPEKARDGYQWGAPMDATREWVSAGEKAGSWIQYNFSPTRTIDAVTLSDRPLLTDQITAGNLQFSDGSTVAVPALPNNGSGLTIKFPAKTVSSVRLNITGVSSGTTNAGLAEFEAYLGADTAAPVVTAAPPGGSYTAGQAITLTANETSTIYYTTNGSTPTTASSKYTAPLILNGPLTLKYFAVDAANNSSAVVTQTYSTGPDVTKPVVTANPVGGQYAAGTTITLSANEPAEIRYTTDGTDPLTAGLTYTTAIPFNGPGPMTLKYFARDTAGNVSEVSTQSYSIPPDTAAPTVTANPTSRALASGATIALSANEPATIYYTTNGSTPTATESATNIKYNPANPVVMGSSTLVLKYIGVDTAGNTSPVGTQTYTVPAAGPPSSHDFNGDGRADVLAADTAGTLYLYPGNASGGLDPRQVALAAPAWSTITDTVTPGDFNKDGKPDLLARAGDILWFYPGNGTGSFGARTQVSTGWSTMTQIFSPGDFSGDGIPDFIGRRSNGELRLYEGNGTGGQRAPYTVGWGWDVMNAIFSTGDFNGDGKADVLARRTDTGALWLYPGDGTGGWLQWTQIGTGWGTRTALVGPRDVDGDGKNDILGRIGDTLWLYPGSGGGTLSNVPPISLGTGWQAMKVIA

SEQ ID NO: 2686 - protein, 914 aa, unknown
  environmental sample
MMKRKFLDPVGRIPMVRAGLALTVALTAGSFLCAPAWAQSSGPQPSPTSEAPGNGSPQGPQPAGNGPASPAAESTPQQGKLPDQQAPITGVELAPGGASAPGAEPSGKAQAQAAKPKTMPGDAPDADSMKAAMRAAIPAGGAEMGQRSPRVVTNKSEKEGAAPARGKAVGAAVKATVPMAADTGHWRPTIGIQGQDVSAHQGNVDWQSQWSQGSRWAYVKASEGNYYLNENYTQQYNGSRNVGMVRGAYHFAIPNWSSGADQARYFVANGGGWSADGYTLPPVLDIEYNPYAGRTINGFYFGNTCYDMSKAQLGQWAADFGNTVKALTGRFPVIYSTTDWWNTCVGNSTFGSYPLWIASYWNNPTNSPGSLPASWNDYSMWQYSSTGPFEGDSNIFNGTFDELRTFARGVPAPANPSIRSGADVLAVMPSGRLDNFPADGQGRISGPVTVGSGWGNALSVHVVDWNQDGVQDLLAQWADGTLQVFRGSSGGGFSSPIQVGSGWQEMSLATGWWNSKDAFPGVIGQDGSGNLYRYQNASGGALGGGVLIGTGFSGHQFNLLDFDGDGSQDLVSRTADGTMRLFRSNGLGSFLSEPAQVIGNGWSSMTSVSSAAGFNGAGSQGLQARAANGDLYYYPAVNGSWGNRFLTGLGWNDAMLIGGAPVNVDATLGVDEPDVLAIRQDGNLYRYAGSGSGGLNAPDLIGKQWTGLKAGFLTDWNGDGALDILAQWNDGRLSLYPGFKGAGFGSPISLGTGWQDWTLTVGTWKKSDSRPSIVGYDPAGRLFQIGNPSGGALGTRTQIGTGWSGLDIVQMDFDKDSNADLVAKTASGDLMLYRSTGTGSFIPEAPSTIGKGWNVINSFGAIRGFAGAGSTGIIGRTTGGELRYYPVGQNRAWGSPSVVGSGWTGMKILSPASR

SEQ ID NO: 2687 - protein, 915 aa, Arthrobacter sp.
MKMKTTSMDPVRRIPLARVGLALTIALIGSSSLGAPAWAQTSGPQPAPQSETREPTPSQGPRPAGDGSGSAPSGSDLPTIEPVPGQQEPPPAVEPSPLEAPLPTSTASGQPEAQRATPQAMPGSANNADAMKAAMRAAIPAGGAEMGQRSPRVLAKQQKAASQPSGAKAVGGAVDTVFPMAADPGHWRPTIGIAGQDVSAHQGNVNWQNQWNQGSRWAYVKASEGNYYLNENYTQQYNGSRSVGMVRGAYHFAIPNWSSGADQARYFVANGGGWTADGYTLPPVLDIEYNPYAGRTINGFYFGNTCYDMSKAQLGQWAADFGNTVKALTGRFPVIYSTTDWWNTCVGNSTFGNYPLWIASYWNNPTNSPGAMPLSWGNYTMWQYSSMGPFEGDSNIFNGTYDQLRTFARGVPRPSSPSIRSGADVLAAMPSGRLDNFPADGQGRITGPVGIGSGWGTAQSVHVVDWNQDGVQDILAQWQDGSLQVFRGASGGGFLAPILVGTGWQEMSLTAGWWNSRDAYPGVIGQDGKGNLYRYVNAAGGALGGGVLIGTGFGGHQFNQLDFDGDGNQDIVSRTNDGIMRLYRSNGVGSFLSEPSRVIGNGWSAMTSVSSSAGFNGAGSQGLQARTANGDLYYYPAVSGSWGNRFLIGVGWNDANVISGAPVNVEATLGVDAQDVVATRQDGNMYRYPGSGSTSLLPAELIGTQWTGLKAGFLADWNNDGTLDILAQWTDGRLSMYPGFKGRGYGAPISLGTGWKDWTLTVGSWKKSDARPSIVGYDPSGRLFHISNPSGTGLGARVQIGVGWAGLAILQMDFDKDTNMDLLAKNAAGDLVLYRSTGSGTLIQEAPDTVGVGWNVINSFGAIRGFAGAGSSGILARTTGGDLRYYPVGQNRSWGTPTRIGTDWGGLRILAPAAS

SEQ ID NO: 2688 - protein, 909 aa, Arthrobacter sp.
MKMKTNSMDPVHRIPLARAGLALTVALLAAGSLGVPAWAQPSGPQPAPHSQTQENPPLQGPRPAGDGSGSSPDSGLPTDGQVPDQQERPAAVEPSPVVTNPTATGQPEAPAATPKSMPGNAPDAEAMKTAMRAAIPAGGAEMGQRSPRVLAKQQKAASQPSGAKAVGGAVDTVFPMAADPGHWRPTIGIAGQDVSAHQGNVNWQNQWNQGSRWAYVKASEGNYYLNENYTQQYNGSRSVGMVRGAYHFAIPNWSSGADQARYFVANGGGWTADGYTLPPVLDIEYNPYAGRTINGFYFGNTCYDMSKAQLGQWAADFGNTVKALTGRFPVIYSTTDWWNTCVGNSTFGSYPLWIASYWNNPTNSPGNLPVSWGNYTMWQYSSTGPFEGDSNIFNGTYDQLRTFARGVPRPSSPSIRSGADVLAAMPSGRLDNFPADGQGRITGPVTIGSGWGTAQSVHVVDWNQDGVQDILAQWRDGSLQVFRGASGGGFLSPLLVGTGWQEMSLTAGWWNSRDAYPGVIGQDGKGNLYRYTNTAGGALNGGVLIGTGFGGHQFNQMDFDGDGNQDIVSRTADGIMRLYRSNGVGSFLSESSRVIGNGWSGMTSVSSAAGFNGSGSQGLHARTANGDLFYYPAVAGSWGNRFLIGVGWNDANVIGGAPVNVESTLGVDPQDVVAARQDGNLYRYPGSGSTSLLPAELIGTQWTGLKAGFLADWNNDGALDIVAQWTDGRLSVYPGFRGRGYGAPISLGTGWKDWTLTVGSWKKSDARPSIVGYDPTGRLFHISNPSGTTLGSRVQIGTGWAGLDIAQMDFDKDSNMDLLAKNAAGDLLLYRSSGSGALVQEAPGVVGTGWNVVNSYGAIRGFAGAGSTGILARTTGGDLRYYPVGQNRSWGSPTKVGTGWGALRIFAPA

SEQ ID NO: 2689 - protein, 916 aa, Arthrobacter sp.
MKMKTTSMDPVRRIPLARVGLALTIALIGSSSLGAPAWAQTSGPQPAPQSETREPTPSQGPRPAGDGSGSAPSGSDLPTIEPVPGQQEPPPAVEPSPLEAPLPTSTASGQPEAQRATPQAMPGSANNADAMKAAMRAAIPAGGAEMGQRSPRVMATKQQSAVSPPSGARSIGGAVNSVVPMAADPGHWRPTIGIAGQDVSAHQGNVNWQTQWNQGSRWAYVKASEGNYYLNENYTQQYNGSRDVGMVRGAYHFAIPNWSSGADQARYFVANGGGWTADGYTLPPVLDIEYNPYAGRTINGFYFGNTCYDMSKAQLGQWAADFGNTVKALTGRFPVIYSTTDWWNTCVGNSTFGNYPLWIASYWNNPTNSPGAMPLSWGNYTMWQYSSTGPFEGDSNIFNGTYDQLRTFARGVPRPSSPSIRSGADVLAAMPSGRLDNFPADGQGRITGPVGIGSGWGTAQSVHVVDWNQDGVQDILAQWQDGSLQVFRGASGGGFLAPILVGTGWQEMSLTAGWWNSRDAYPGVIGQDGKGNLYRYVNAAGGALGGGVLIGTGFGGHQFNQLDFDGDGNQDIVSRTNDGIMRLYRSNGVGSFLSEPSRVIGNGWSAMTSVSSSAGFNGAGSQGLQARTANGDLYYYPAVSGSWGNRFLIGVGWNDANVISGAPVNVEATLGVDAQDVVATRQDGNMYRYPGSGSTSLLPAELIGTQWTGLKAGFLADWNNDGTLDILAQWTDGRLSMYPGFKGRGYGAPISLGTGWKDWTLTVGSWKKSDARPSIVGYDPSGRLFHISNPSGTGLGARVQIGVGWAGLAILQMDFDKDTNMDLLAKNAAGDLVLYRSTGSGTLIQEAPDTVGVGWNVINSFGAIRGFAGAGSSGILARTTGGDLRYYPVGQNRSWGTPTRIGTDWGGLRILAPAAS

SEQ ID NO: 2690 - protein, 913 aa, Arthrobacter sp.
MKMENSSMDPVRRIPLARTALALTMALVGGSCLGAPAWAQSSGPQPAPTSDVQEASPSQGPRPAGNGPGSGTPGSEMPSSTSVSKQQEPPPAVGPSPAVTPAPTSKASGQSATPTPQASPGTAPDADAMKAAMRAAIPAGGAEMGQRSPRVLSAKQQNATSPASGSKAIGGAVTSAVPMAADTGHWRPTIGIAGQDVSAHQGNVNWQSQWNQGSRWAYVKASEGNYYLNENYTQQYNGSRNVGMVRGAYHFAIPNWSSGADQARYFVANGGGWTADGYTLPPVLDIEYNPYAGRTINGFYFGNTCYDMSKAQLGQWAADFGNTVKALTGRFPVIYSTTDWWDTCVGNSTFGNYPLWIASYWNNPTNSPGDMPLSWGNYTMWQYSSTGPFEGDSNIFNGTYDQLRTFARGVSRPSSPSIRSGADVLAAMPSGRLDNFPADGQGRITGPVAIGSGWGTAQSVHVVDWNQDGIQDVLAQWQDGSLQVFRGAAGGGFLAPILVGTGWQEMSLTVGWWNSRDAYPGVIGQDGKGNLYRYANPGAGALSGGVLIGTGFGGHQLNQLDFDGDGNQDIVSRTSDGIMRLYRSNGVGSFVSEPSRVIGNGWSAMTSISSAAGFNGAGSQGLQARTANGDLYYYPAVSGSWGNRFLIGVGWNDANVISGAPVDVETTLGVDAPDVVAARQDGNLYRYPGSGSTSLLPTEVIGTQWTGLKAGFLTDWNNDGALDILAQWSDGRLSVYPGLKGRGYGTPISLGTGWKDWTLTVGKWKKSDARPSIVGYDPSGRLFQISNPSGTGLGARVQIGTGWAGLDILQMDFDKDSNMDLLAKNAAGDLVLYRSNGSGAFVQEPTETVGIGWNVINSFGSIRGFAGAGSTGILARTSSGDLRYYPVGQNGSWGTPTRVGTDWGGLKILAPAS

SEQ ID NO: 2691 - protein, 505 aa, Multievos46 sp.
MAACAVFLGLVLAAALAPAADAAAPASAAPTAQATRYVSEAGVTAHRAAVVNAAAVKAQVPSTANPLPGLDPAGDPANLSVLVNKSRPLNPATYAPADLVNARGSGQYLRAEAAAWLNGLFQGAADAGTGGLAVVSGYRSYAQQQQVYSSYVNLYGQAQADLISARPGYSEHQTGLAVDVGNANGSCGLSTCFGDTAAGMWVAANTYKYGFIVRYPNGYTNITGYSYEPWHLRYVGVDLATDMKRRGFATLEQYFSGNPSVHASITSGADLVAADAAGRLLRYPALPSGGYGVPVQIGSNWTGLKQAFVVDWDSDGVYDLLAQWNNGTLGLFKGWPGGAFSTQIVVGTGDWDAMTITVGKWSSDQGYPGVVGYFPDGGLRYYPNTSGRALTYRVDIGTGWAGLGLTMADWDADGANDILATTSSGLLLSYPGNGVGGFKGQPSIIGSGWGTMKALVPGFGLSGPGTRNITAQTVDGYLVDYGLGLGVWGPQRQVGNGWGSMKLFK

SEQ ID NO: 2692 - protein, 476 aa, unknown
  environmental sample
MAACAAFLALALASALAPAAGAVPAVVNAMVPSAANPLPGLDPAGDPANLSVLVNKSRPLNPATYVPADLVNARGSGQYLRAEAAAWLNGLFQGAADAGTGGLAVVSGYRSYAQQQQVYSSYVNLYGQAQADLISARPGYSEHQTGLAVDVGNANGSCGLSTCFGDTAAGIWVAANAHKYGFIVRYPNGYTNITGYSYEPWHLRYVGLDLATDMKRRGFATLEQYFSGNPSVYASITSGADLVAADPSGRLLRYPALPSGGYGVPVQIGSNWTGLKQAFVVDWDSDGVYDLLAQWNNGTLGLFKGWPGGAFSTQIVVGTGDWDAMTITVGKWSSNQGYPGVVGYFPDGGLRYYPNTSGRALTYRVDIGTGWAGLGLTMADWDADGANDILATTASGLLLNYPGNGVGGFKGLPGSIGSGWGTMKALVPSFGLSGPGTRSITAQTVDGFLVDYGLGTGVWGSQRQVGNGWGSMTLFK

SEQ ID NO: 2693 - protein, 504 aa, Arthrobacter sp.
MRSHIRSGSMGNARRRLAACAAVFSLAVAGGVVAAAPATAAPTQAVTTTAPAAVAQTAVPTTANPLPSVDPVGDPANLSVLVNKSRPLNPVSYAPGDLVNARGSGQYLRAEAAAWLNGLFQGAADAGTGGLAVVSGYRSYAQQQQVYSYYVSIYGQAQADLISARPGHSEHQTGLAVDVGNANGSCGLSTCFGDTAAGIWVAANAHRYGFIVRYPNGYTNVTGYSYEPWHLRYVGVDLATEMKRRGFPTMEQYFAGNPTAYASITSGADLVAADSSGRLLRYPAHGGGGYGIPSVIGSNWHGLKQAFVVDWDADGVYDILAQWDNGTLGLFKGWPGGAFSTQIVVGTGDWDKMTITVGKWSAAQGYPGIVGYFPDGGLRYYPNTSGRALSYRVDIGSGWAGMGLTMADWNGDGANDILAITTSGHLLSYPGNGGGGFAGLPATVGSGWGTMKALVPSFGLSGPGTRSITAQTVDGYLVDYALGVGVWGAQRQVGNGWNGMKLFR

SEQ ID NO: 2694 - protein, 513 aa, Arthrobacter sp.
MPAADYKQIGGVMRGQFHPGSMRNARRRLAACAAFFSLTVAGGVIAAAPATAAPAPSNARAAVVQSAVPTTANPLPSVDPVGDPANYSVLVNKSRPLSPLSYAPGDLVNARGSGQYLRAEAAAWLNGLFQGAADAGTGGLAVVSGYRSYAQQQQVYSYYVSIYGQAQADLISARPGHSEHQTGLAVDVGNANGSCGLSTCFGDTPAGVWVAANAHKYGFIVRYPNGYTNVTGYSYEPWHLRYVGVDLATDMKRRGFPTMEQYFAGNPTAYASITSGADLVAADSSGRLLRYPAHGGGGYGIPTVIGSNWQGLKQAFVVDWDADGVYDILAQWDNGTLGLFKGWPGGAFSTQIVVGTGDWDKMTITVGKWSAAQGYPGIVGYFPDGGLRYYPNTSGRALTYRVDIGSGWAGMGLTMADWNADGANDILATTTSGHLLSYPGNGGGGFAGLPTTVGSGWGTMKALVPSFGLSGPGTRSITAQTVDGYLVDYRLGTGAWGAQRQVGNGWNGMKLFR

SEQ ID NO: 2695 - protein, 515 aa, Arthrobacter sp.
MRLATSKLGGVMRSHIRSGSMGNARRRLAACAAVFSLAVAGGVVAAAPATAAPTQAVTTTAPAAVAQTAVPTTANPLPSVDPVGDPANLSVLVNKSRPLNPVSYAPGDLVNARGSGQYLRAEAAAWLNGLFQGAADAGTGGLAVVSGYRSYAQQQQVYSYYVSIYGQAQADLISARPGHSEHQTGLAVDVGNANGSCGLSTCFGDTAAGIWVAANAHRYGFIVRYPNGYTNVTGYSYEPWHLRYVGVDLATDMKRRGFPTMEQYFAGNPTAYASITSGADLVAADSSGRLLRYPAHGGGGYGIPSVIGSNWHGVKQAFVVDWDADGVYDILAQWDNGTLGLFKGWPGGAFSTQIVVGTGDWDKMTITVGKWSAAQGYPGIVGYFPDGGLRYYPNTSGRALSYRVDIGSGWAGMGLTMADWNADGANDILAITTSGHLLSYPGNGGGGFAGLPATVGSGWGTMKALVPSFGLSGPGTRSITAQTVDGYLVDYALGVGVWGAQRQVGNGWNGMKLFR

SEQ ID NO: 2696 - protein, 514 aa, Arthrobacter sp.
MPAAGYKKIGGVMRGKNHSGSVRNARRRLAACAAIFSLAVAVGVMAGTPATAAPVPGTAAQAAVVQAAVPTAANPLPSVDPVGAPSNYSVLVNKSRPLNPVSYAPGDLVNARGSGQYLRAEAAAWLNGLFQGAADAGTGGLAVVSGYRSYAQQQQVYSYYVSIYGQAQADLISARPGHSEHQTGLAVDVGNANGSCGLSTCFGDTAAGIWVAANAHKYGFIVRYPNGYTNITGYSYEPWHLRYVGVDLATDMKRRGFPTMEQYFAGNPTAYASITSGADLVAADSSGRLLRYPAHGGGGYGVPTVIGSNWHGLKQAFVVDWDSDGVYDILAQWDNGTLGLFTGWPGGAFSTQIVVGTGDWDKMTITVGKWSAAERFPGVVGYFPDGGLRYYPNTLGRALIYRVDIGSGWAGMGLTMADWNADGANDILATTTSGQLLSYPGNGGGGFAGLPATVGSGWGTMKALVPSFGLSGPGTRSITAHTVDGLLVDYALGAGAWGTQRQVGKGWNGMKLFK

SEQ ID NO: 2697 - protein, 155 aa, Bacillus sp.
MSIEVGSKLQGKVTGITNFGAFVELPGGTTGLVHISEVADNYVKDINDHLKVGDEVEVKVINVEKDGKIGLSIKKAVERAERPERPERPARAPRSDRPRDSHRPQRNNRGGGNDFRSKETFEQKMNRFLKDSEERLSSLKRHTESKRGGRGAKRG

SEQ ID NO: 2698 - protein, 152 aa, Bacillus sp.
MSIEVGSKLQGKVTGITNFGAFVELPGGSTGLVHISEVADNYVKDINDHLKVGDMVEVKVINVEKDGKIGLSIKKAIDRPDRPERPERPRQDRPRTDRPHRGGGGGAGRNEFRPKENFEQKMSRFLKDSEDRLSSLKRNTESKRGGRGAKRG

SEQ ID NO: 2699 - protein, 150 aa, Bacillus sp.
MSIEVGSKLQGKVTGITNFGAFVELSGGTTGLVHISEVADNYVKDINDHLKVGDEVTVKVINVEKDGKIGLSIKKAIDRPERPERSERPNRSDRPNRSDRPRGRTNTNEFRPKENFEQKMSRFLKDSEDRLSSLKRNTESKRGGRGARRG

SEQ ID NO: 2700 - protein, 146 aa, Bacillus sp.
MSIEVGSKLQGKVTGITNFGAFVELPGGSTGLVHISEVADNYVKDINDHLKVGDEVTVKVINVENDGKIGLSIKKAIDRPERPQRPERPRNSDRPRSRGNDFRNNSNNKENFEQKMNRFLKDSEDRLASLKRNTESKRGGRGARRG

SEQ ID NO: 2701 - protein, 145 aa, Bacillus sp.
MSIEVGSKLQGKVTGITNFGAFVELPNGSTGLVHISEVADNYVKDINDHLKVGDQVEVKVINVEKDGKIGLSIKKAKDRPEPERRQHSNSHSQRPRQGRPNDRNNNKGETFESKMSKFLKDSEDRLSSLKRHTESKRGGRGAKRG

SEQ ID NO: 2702 - protein, 151 aa, Bacillus sp.
MSIEVGSKLKGKVTGITKFGAFVELPEGSTGLVHISEVADKYVKDINEHLKVGDMVEVKVINVEKDGKIGLSIKKAKDRPERSERPERGDRKEFRPNSNSGRPRQNRSNDHRPKENFEAKMARFLKDSEDRLSSLKRHTESKRGGRGAKRG

SEQ ID NO: 2703 - protein, 163 aa, Bacillus sp.
MSIEVGSKLQGKVTGITNFGAFVELPEGATGLVHISEVADNYVKDINEHLKVGDEVEVKVINVEKDGKIGLSIKKAKDRPERPERPERPERPQYERGERRESRGGYSGGNSQRSRNAKSNDNRAPKENFESKMARFLKDSEDRLASLKRNTESKRGGRGARRG

SEQ ID NO: 2704 - protein, 145 aa, Bacillus sp.
MSIEVGSKLQGKVTGITNFGAFVELPDGSTGLVHISEVADNYVKDINDHLKVGDQVEVKVINVEKDGKIGLSIKKAKDRPETPQRSHSNSHSQRPRQGRTNDRNNSRPENFETKMAKFLKDSEDRLSSLKRHTESKRGGRGARRG

SEQ ID NO: 2705 - protein, 152 aa, Bacillus sp.
MSIEVGSKLQGKVTGITNFGAFVELPEGLTGLVHISEVADNYVKDINDHLKVGDQVEVKVINVEKDGKIGLSIKKAKERPKAEGEQQQQQRSGRPQRNRSFNRDNRDRDSFRQPKENFEQKMARFLKDSEDRLASLKRNTESKRGGRGARRG

SEQ ID NO: 2706 - protein, 128 aa, Bacillus sp.
MSIEVGSKLQGKITGITNFGAFVELPGGSTGLVHISEVADNYVKDINEHLKVGDQVEVKVINVEKDGKIGLSIKKAKDRPQARPRNDFRPKESFEQKMNKFLKDSEDRLSSLKRNTESKRGGRGARRG

SEQ ID NO: 2707 - protein, 157 aa, Bacillus sp.
MSIEVGSKLQGKVTGITHFGAFVELPGGSTGLVHISEVADNYVKDINEFLKVGDEVEVKVVNVEKDGKIGLSIRKAKERPEGAERSEKPARPTRPARPSRPYQSSSARPQGQGQRNHRPGPSFEDKMSRFLKDSEERLSIIKRQTDSKRGGRGARRG

SEQ ID NO: 2708 - protein, 145 aa, Kurthia sp.
MSIEVGSKVQGKVTGITNFGAFVELPDKSTGLVHISEVADNYVKDINDHLTVGDVVEVKVMNVESDGKIGLSIRKAKPESERPQRPERPQRSRNNNRGGNRNEHRPQQENFEQKMARFIKDSDERLATLKRATDSKRGGRGARRS

SEQ ID NO: 2709 - protein, 147 aa, Bacillus sp.
MSIEVGSKLQGKVTGITKFGAFVQLPEGSTGLVHISEVADNYVKDINDHLTVGDEVEVKVLNVEKDGKIGLSIRKAKDNPPPQTQYRPRPQRQGDFRQKGGPRGGGQPPVENFESKVARFLKDSEERMTTLKRQTDSRRGGRGGRRG

SEQ ID NO: 2710 - protein, 132 aa, Anoxybacillus sp.
MSIEVGSKLQGKVTGITKFGAFVELPEGVTGLVHISEVADNYVKDINDHLKVGDVVEVKVINVEKDGKIGLSIKKAKESQSSQRPRTKANDRAAKESFEQKISRFLKESEDRLASLKRHTESKRGGRGARRG

SEQ ID NO: 2711 - protein, 337 aa, Bacillus sp.
MNIKRWLLTVTTVILATFGVSAVPSVHASEEKETAYIDVAAATLWTAPNILREVDAPSATNPVDMKKWTTSMNLKQKQQLSSDGMLETQALYGNKVTVLERQGDWVKVAVDGQPTSRNELGYPGWMPTKQLTYSKRYEQYAKKPFVMVTAPTTYLYHSPSLKKKGIEVSYNTRLPLLVKSKSAYKVLKPNGKTAWVSAKAGKIYASQKDIPVPTGTELVESGKAFLNLPYLWAGMSGFGFDCSGFTFTMYQSHGITIPRDSGPQSRAGKPVEMNNLQPGDLLFFAYNQGKGSVHHVAMYAGDGMMIHSPNSERTVEIIPLNTKGYIEEYAGARRYLP

SEQ ID NO: 2712 - protein, 337 aa, Bacillus sp.
MNIKRWLLTVTTVILATFGVSAVPSVHASEEKETAYIDVAAATLWTAPNILREVDAPSATNPVDMKKWTTSMNLKQKQQLSSDGMLETQALYGNKVTVLERQGDWVKVAVDGQPTSRNELGYPGWMPTKQLTYSKRYEQYAKKPFIMVTAPTTYLYHSPSLKKKGIEVSYNTRLPLLVKSKSAYKVLKPNGKTAWVSAKAGKIYASQKDIPVPTGTELVESGKAFLNLPYLWAGMSGFGFDCSGFTFTMYQSHGITIPRDSGPQSRAGKPVEMNNLQPGDLLFFAYNQGKGSVHHVAMYAGDGMMIHSPNSERTVEIIPLNTKGYIEEYAGARRYLP

SEQ ID NO: 2713 - protein, 337 aa, Bacillus sp.
MNIKRWLLTATTVILATFGVSAVPSVHASEEKETAYIDVAAATLWTAPNILREVDAPSATNPVDMRKWTTSMNLKQKQQLSSDGMLETQALYGNKVTVLDEQGDWVKVAVDGQPTSRNELGYPGWMPTKQLIYSKRYEQYAKKPFVMVTAPTTYLYHSPSLKKKGIEVSYNTRLPLLAKSKSAYKVLKPNGKTAWISTKAGKIYASQKDIPVPTGTELVESGKAFLNLPYLWAGMSGFGFDCSGFTFTMYQSHGITIPRDSGPQSRAGKPVDMNNLQPGDLLFFAYNQGKGSVHHVAMYAGDGMMIHSPNSERTVEIIPLNTKGYIEEYAGARRYLP

SEQ ID NO: 2714 - protein, 337 aa, Bacillus sp.
MNIKRWFLTATTVILATFGVSAVPSVHASEEKETAYIDVAAATLWTAPNILREVDAPSATNPVDMRKWTTSMNLKQKQQLSSDGMLETQALYGNKVTVLDEQGDWVKVAVDGQPTSRNELGYPGWMPTKQLTYSKRYEQYAKKPFVMVTAPTTYLYHSPSLKKKGIEVSYNTCLPLLAKSKSAYKVLKPNGKTAWISTKAGKIYASQKDIPVPTGTELVESGKAFLNLPYLWAGMSGFGFDCSGFTFTMYQSHGITIPRDSGPQSRAGKPVDMNNLQPGDLLFFAYNQGKGSVHHVAMYAGDGMMIHSPNSERTVEIIPLNTKGYIEEYAGARRYLP

SEQ ID NO: 2715 - protein, 337 aa, Bacillus sp.
MNIKGWLLTVTTVILTTFGVSAAPSVHASEEKETAYIDVAAATLWTAPNILREVDAPSATNPVDMKKWTTSMNLKQKQQLSSDGMLETQALYGNKVTVLDKQGDWVKVAVDGQPTSRNELGYPGWMPTKQLTYSKRYEQYAKKPFVMVTTPTTYLYHSPSLKKKGIEVSYNTRLPLLVKSKSAYKVLKPNGKTAWISTKAGKIYTSQKDIPVPTGTELVESGKAFLNLPYLWAGMSGFGFDCSGFTFTMYQSHGITIPRDSGPQSRAGKPVDMNNLQPGDLLFFAYNQGKGSVHHVAMYAGDGMMIHSPNSERTVEIIPLNTKGYIEEYAGARRYLP

SEQ ID NO: 2716 - protein, 326 aa, Bacillus sp.
MVILATFGVSAVPSVHASEEKETAYIDVAAATLWTAPNILREVDAPSATNPVDMRKWTTSMNLKQKQQLSSDGMLETQALYGNKVTVLDEQGDWVKVAVDGQPTSRNELGYPGWMPTKQLTYSKRYEQYAKKPFVMVTAPTTYLYHSPSLKKKGIEVSYNTRLPLLAKSKSAYKVLKPNGKTAWISTKAGKIYASQKDIPVPTGTELVESGKAFLNLPYLWAGMSGFGFDCSGFTFTMYQSHGITIPRDSGPQSRAGKPVDKNNLQPGDLLFFAYNQGKGSVHHVAMYAGEGMMIHSPNSERTVEIIPLNTKGYIEEYAGARRYLP

SEQ ID NO: 2717 - protein, 324 aa, Bacillus sp.
MLATFGVSAVPSVHASEEKETAYIDVAAATLWTAPNILREVDAPSATNPVDMRKWTTSMNLKQKQQLSSDGMLETQALYGNKVTVLDEQGDWVKVAVDGQPTSRNELGYPGWMPTKQLIYSKRYEQYAKKPFVMVTAPTTYLYHSPSLKKKGIEVSYNTRLPLLAKSKSAYKVLKPNGKTAWISTKAGKIYASQKDIPVPTGTELVESGKAFLNLPYLWAGMSGFGFDCSGFTFTMYQSHGITIPRDSGPQSRAGKPVDMNNLQPGDLLFFAYNQGKGSVHHVAMYAGDGMMIHSPNSERTVEIIPLNTKGYIEEYAGARRYLP

SEQ ID NO: 2718 - protein, 109 aa, Bacillus sp.
MQQFLHSMKHYAIFFAVIAALTYVLTLVLGADKVDLDKYSTVTITKGDTLWELSNKYHNHHHLTTNEFVKWVEDVNDLNSDTAQSLSPGDKLYIPVLKKELHNQVAIEQ

SEQ ID NO: 2719 - protein, 109 aa, Bacillus sp.
MQQFLHSMKHYAIFFAVIAALTYVLTLVLGADKVDLDKYSTVTITKGDTLWELSNKYHNHHHLTTNEFVKWVEDVNDLNSDTVQSLSPGDKLYIPVLKKELHNQVAIEQ

SEQ ID NO: 2720 - protein, 109 aa, Bacillus sp.
MQQFLHSMKHYAIFFAVIAALTYVLTLVLVADKVDLDKYSTVTITKGDTLWELSNKYHNRHHLTTNEFVKWVEDVNDLNSDTAQSLSPGDKLYIPVLKKELHNQVAIEQ

SEQ ID NO: 2721 - protein, 109 aa, Bacillus sp.
MQQFLHSMKHYAIFFAAIAALTYVLTLVLGADKVDLDKYSTVTITKGDTLWDLSNKYHNHHHLTTNEFVKWVEDVNDLNSDTAQSLSPGDKLYIPVLKQELHNQVAIEQ

SEQ ID NO: 2722 - protein, 426 aa, Bacillus sp.
MQNRYRHIIGAILLVSFIFVGFIPVVQQYIHIPKQIVLFEQQKAKINTTLPLSVEASSPVYDVTSNKAKLTVAGKQVGKEELMLHLAGIPVKRVDVQVLSDFRVIPGGQSIGVKLNSKGVLVVGYHQVDTAKGKRSPGEIAGIQVGDMITKINGKTIEKMSDITPFIQQAGKTGEPLNLHILREKKQFDTKLYPLKDKQDYAYRIGLYIRDSAAGIGTMTFYDPKSKKYGALGHVISDMDTKKPIVVEDGQIVRSTVTSIEKGSNGVPGEKLARFSEDRQIIGNITRNSPFGIFGKLSSTMENGIMDKAMPIALSHQVKEGPAKILTVVDDDQVEEFDIEIMSTIPQKFPATKGMVIKITDPKLLKKTGGIVQGMSGSPIIQNGKVVGAVTHVFVNDPTSGYGVHIEWMLNEAGIDIYKNNRKKAS

SEQ ID NO: 2723 - protein, 425 aa, Bacillus sp.
MNNRLRYIIGAILLVSFIFVGFIPVVQQYLTIPKQMTLFKSDEVNFSTSLAVSTHSNDVIETMKQDAKLSIAGKEVGKEEMMLHLAGVPVKRVDVQVLSDFKVIPGGQSIGVKLNSKGVLVVGYHQVDTKDGKKSPGEIAGIQVGDMITKINGKTIEKMSDITPFIQQAGKTGEPLKLQVMREKEQLQTKLYPLKDKEDYAYRIGLYIRDSAAGIGTMTFYDPKSKKYGALGHVISDMDTKKPIVVEDGQIVRSTVTSIEKGENGVPGEKLARFSENKEIIGNIKTNSPFGIFGKLSETMENGILDKPMPISLSHQVKEGPAKILTVVENDKVEEFDVEVVSSVPQKFPATKGMVIKITDKKLLEKTGGIVQGMSGSPIIQDGKVIGAVTHVFVNDPTSGYGVHIEWMLNEAGINIYKKESKRAS

SEQ ID NO: 2724 - protein, 428 aa, Bacillus sp.
MLNRYRKIIGVILLVSLISLGFFPSVRHYVNIPKNIVLFEGQTEMVSSALPVTAKPQDQHVYEMNADGKAELTISGHQFGKEELMLELAGIPVKKVNVDVLPDFKVIPGGQSIGVRLNSRGVLVVGYHQVDTKEGKKSPGEIAGIQVGDMITTINGTKIEKMSDITPFIQEAGKTGKPLNLVIARDQKEFRTKLFPLKDKQEYAYRIGLYIRDSAAGIGTMTFYDPISKKYGALGHVISDMDTKKPIVVEDGQIVKSTVTSIEKGSNGVPGEKLARFSTDKNIIGNITRNSPFGIFGKLNQQIQNGKLDKPMPIALSHQVKEGPATILTVVDNDRVEEFDVQIVSTVPQKFPATKGMVIKITDPKLLEKTGGIVQGMSGSPIIQDGKVIGAVTHVFVNDPTSGYGVHIEWMLNEAGIDIYKQNSKKAS

SEQ ID NO: 2725 - protein, 425 aa, Bacillus sp.
MDRYRKWIGTILLVSLIVIGFIPSVQQYVKIPTNITLFENQTLPIQSAQQVSSNQPNVSVEPEKESSTWQVSGNNAGESKLVVQAGAFPAKEVDVKVLPDFKVYPGGQSIGVKLNSKGVLVVGYHQVDTKEGKKSPGEIAGIQVGDMITEINGKNIEKMSDVTPFIKQAGKSGDPLNITVTRDDQSIKTKLYPLKDKGDYAYRIGLYIRDSAAGIGTMTFFEPNSKKYGALGHVISDMDTKKPIVVKDGQIMKSTVTSIEKGSDGAPGEKLARFSSERSVIGDITRNSPFGIYGKLTEQVENNIVNKPLPIALSHQVKKGPAKILTVIEENKVEEFSVEIVSTVDQKFPATKGMVIKVTDPKLLEKTGGIVQGMSGSPIIQDGRLVGAVTHVFVNDSTSGYGVHIEWMLNEAGIDIYEHPRQKAS

SEQ ID NO: 2726 - protein, 430 aa, Bacillus sp.
MQTDKMRKLVGVLLLVLIMSLGFVKEVQEYVKMPKTVTVFESQTVSVDNSLPVNANQPSEEAFTVQKNNDGKTLDIHGKEAGEGEVVFDLAGFPVKKAGVKVLPDFKVIPGGQSIGVKLNTLGVLVVGHHQIATTDGKKSPGELAGVEIGDIITHINGKKIEQMSDVTPFIQKAGKTGEPLDLVLNREQVEVKTKLYPLKDEHDHSYRIGLYIRDSAAGIGTMTFYDPKSKKYGALGHVISDMDTKKPIVVDNGQIVRSTVTSIEKGSNGNPGEKLARFSSDRQVIGNITRNSPFGIFGELNQGINNGVMDKAMPIALSNEVKEGPAKILTVVDQDKVEEFEVEVVSSVPQKFPATKGMVIKITDQRLLDKTGGIVQGMSGSPIIQNGKVIGAVTHVFVNDPTSGYGVHIEWMLNEAGIDIYGNQEQKAS

SEQ ID NO: 2727 - protein, 429 aa, Bacillus sp.
MGSDKIRKIIGCILLVSLMSLGFVKPVKEYVLLPNSLTVFENQQLSMQTSLQADAAAADSEQVFSIKTGSESLQIEGRQSGVGEIVFDLAGIPIKKVDVKVLEDFRVIPGGQSIGVKLNSLGVLVVGHHQIKTSGGKKSPGEIAGVQVGDIITKINGTTVESMSDVTPFIQGSGKTGKPLDLVISRDNKELKTKLVPVKDENEGAYRIGLYIRDSAAGIGTMTFYDPKSKKYGALGHVISDMDTKKPIVVQDGQVVRSTVTSIEKGSNGNPGEKLARFSSDRQIIGDITRNSPFGIFGRLNGDMTNGLYDKPMPIALSNEVKEGPAHILTVVDGDRVEEFDVQVVSSTPQKFPAIKGMVIKITDPKLLEKSGGIVQGMSGSPIIQNGKVIGAVTHVFVNDPTSGYGVHIEWMLSEAGIDIYTQGAKKAS

SEQ ID NO: 2728 - protein, 137 aa, Bacillus sp.
MIRKWVAVCVVFAAFIFPQAVSAEQPKVEVFQIETGKVVRSTPKPPSVQKEAEKSIASITGLYKKASPLPKKGYLVKVPLDPAVKIENSAVNTLASEVIFVLEPNQKPIMMVFDNENRTYFFEFTHDLTLLRKALQL

SEQ ID NO: 2729 - protein, 137 aa, Bacillus sp.
MIRKWVAVCVVFAAFIFPQAVSAEQPKVEVFQIETGRVVRSTLKPPSVQKEAEKSIASITGLYKKASPLPKKGYLVKVPLDPAVKIENSAVNTLASEVIFVLEPNQKPIMMVFDNENRTYFFEFTHDLTLLRKALQL

SEQ ID NO: 2730 - protein, 137 aa, Bacillus sp.
MIRKWVAVCVVFAAFIFPQAVSAEQPKVEVFQIETGRVVRSTLKPPNVQKEAEKSIASITGLYKKASPLPKKGYLVKVPLDPAVKIENSAVNTLASEVIFVLEPNQKPIMMVFDNENRTYFFEFTHDLTLLRKALQL

SEQ ID NO: 2731 - protein, 137 aa, Bacillus sp.
MIRKWVAVCVVFAAFIFPQAVSAEQPKVEIFQIETGRVVRSTLKPPNVQKEAEKSIASITGLYKKASPLPKKGYLVKVPLDPAVKIENSAVNTLASEVIFVLEPNQKPIMMVFDNENRTYFFEFTHDLTLLRKALQL

SEQ ID NO: 2732 - protein, 137 aa, Bacillus sp.
MIRKWVAVCVVFAGFIFPQAVSAEQPKVEIFQIETGRVVRSTLKPPNVQKEAEKSIASITGLYKKASPLPKKGYLVKVPLDPAVKIENSAVNTLASEVIFVLEPNQKPIMMVFDNENRTYFFEFTHDLTLLRKALQL

SEQ ID NO: 2733 - protein, 137 aa, Bacillus sp.
MIRKWVAVCVVFAAFIFPQAVNAEQPKVEIFQIETGRVVRSTLKPPNVQKEAEKSIASITGLYKKASPLPKKGYLVKVPLDPALKIENSAVNTLASEVIFVLEPNQKPIMMVFDNENRTYFFEFTHDLTLLRKALQL

SEQ ID NO: 2734 - protein, 501 aa, Bacillus sp.
MKKICMSLIVLCLFSGGLAPMSKGAAASSVGTVKGDNVNVYRSPSLHSSVMQTVKKGEEFPVISSEAGDAAQVTTHTVVPGNTLWLLAKQYGVTVSDLIKQNQLKKTELIPGQTLKIPPKGLLHKVVSGDTLWKVSVKYGVKANELTKLNQLSSTNIKPGQMLIIPDYYVQVQLLEGKKGWIKKSDLVQKKHQPVVMGWSFNEKTAGYTESMKQKNLDVVSPRWFTLTSNDKVVSSSINESYVQTAHKNGKKVWPLIGNNFDDVLTSDVLSNKAKRKKLVSSIESSLVKTNSDGINVDFENINIKNKQDFVLFIKELKAALKPHGMTISVDVTRENNDPFWSGSFDRKQIGQVADYVIMMGYEEHWGGSQVPGSVASLPWVKEGTQLLMKDVPAHKILLGVPFYTREWKTDLSTKKVVTKDLTMKEAESVISSKKLAKKWDSQASQYYVEYAENGTKHQIWLEDKASMQRRVKLINDYHLGGAAAWYIGSETSDIWELYNF

SEQ ID NO: 2735 - protein, 501 aa, Bacillus sp.
MKKLCMSLIVLCLFSGGLAPMSKGAAASSVGTVKGDNVNVYHSPSLHSSVMQTVKKEEEFPVISSEAGDAAQVTTHTVVPGNTLWLLAKQYGVTVSDLIKQNQLKKTELIPGQTLKIPPKGLLHKVVSGDTLWKVSVKYGVKANELTKLNQLSSTNIKPGQTLIIPDYYVQVQLLEGKKGWIKKSDLVQKKHQPVVMGWSFNEKTAGYTESMKQKNLDVVSPRGFTLTSNDKVVSTSINESYVQTAHKNGKKVWPLIGNNFDDVLTSDVLSNKAKRKKLVSSIESSLVKTNSDGINVDFENINIKNKQDFVLFIKELKAALKPHGMTISVDVTRENNDPFWSGSFDRKQIGQVADYVIMMGYEEHWGGSQIPGSVASLPWVKEGTQLLMKDVPAHKILLGVPFYTREWKTDLSTKKVVTKDLTMKEAEAVISSKKLAKKWDSQASQSYVEYTENGTKHQIWLEDKASMQRRVKLINDYHLGGAAAWYIGSETSDIWELYNF

SEQ ID NO: 2736 - protein, 481 aa, Bacillus sp.
MSKGAAASSVGTVKGDNVNVYRSPSLHSSVMQTVKKGEEFPVISSEAGDAAQVTTHTVVPGNTLWLLAKQYGVTVSDLIKQNQLKKTELIPGQTLKIPPKGLLHKVVSGDTLWKVSVKYGVKANELTKLNQLSSTNIKPGQMLIIPDYYVQVQLLEGKKGWIKKSDLAQKKHQPVVMGWSFNEKTAGYTESMKQKNLDVVSPRWFTLTSNDKVVSSSINESYVQTAHKNGKKVWPLIGNNFDDVLTSDVLSNKAKRQKLVSSVESSLVKTNSDGINVDFENINIKNKQDFVLFIKELKAALKPHGMTISVDVTRENNDPFWSGSFDRKQIGQVADYVIMMGYEEHWGGSQVPGSVASLPWVKEGTQLLMKDVPAHKILLGVPFYTREWKTDLSTKKVFTKDLTMKEAEAVISSKKLTKKWDSQSSQYYVEYTENGTKHQIWLEDKASMQRRVNLIKDYHLGGAAAWYIGSETSDIWELYNF

SEQ ID NO: 2737 - protein, 508 aa, Bacillus sp.
MGRRDDKMKKICMSLLILCLFSGGLAPISKGDAASSVGTVKGDNVNVYRSPSLHSSVVQTVKKGEEFPAISSEAGDAAQVITHKVVPGNTLWLLAKQYGVTVSELIKQNQLKTTELTPGQTLKIPPKGLLHKVVSGDTLWKISVKYGVKANELTKLNQLSSTNIEPGQTLVIPDYYVQVQLLEGKKGWIKKSDLVQQKHQPVVMGWSFNEKTAGYEESMKQKNLDVVSPRWFTLTRSDKVVSSSINPSYVQTAHKNGKKVWPLIGNNFDDVLTSDVLSNKAKRQKLVSSVESSLVKTNSDGINVDFENINIKNKQDFVLFIKELKAALKPHGMTVSVDVTRENNDPFWSGSFDRKQIGQVADYVIMMGYEEHWGGSQVPGSVASLPWVKEGTELLMKDVPAHKILLGVPFYTREWKTDLSTKKVVTKDLTMKEAEAIISSKKLTKKWDSQASQYYVEYTENGTKHQIWLEDKASMQRRVKLINDYHLGGAAAWYIGSETSDIWELYNF

SEQ ID NO: 2738 - protein, 481 aa, Bacillus sp.
MSKGAAASSVGTVKGDNVNVYRSPSLHSSIMQTVKKGEEFPVISSEAGDAAQVTTHTVVPGDTLWLLAKQYGVTVSDLIKQNQLKKTELIPGQTLKIPPKGLLHKVVSGDTLWKVSVKYGVKANELTKLNQLSSTNIKPGQMLIIPDYYVQVQLLEGKKGWIKKSDLAQRKHQPVVMGWSFNEKTAGYTESMKQKNLDVVSPRWFTLTSNDKVVSSSINESYVQTAHKNGKKVWPLIGNNFDDVLTRDVLSNKAKRKKLVSSVESSLVKTNSDGINVDFENINIKNKQDFVLFIKELKAALKPHGMTISVDVTRENNDPFWSGSFDRKQIGQVADYVIMMGYEEHWGGSQVPGSVASLPWVKEGTQLLMKDVPAHKILLGVPFYTREWKTDLSTKKVVTKDLTMKEAEAVISSKKLTKKWDSQASQYYVEYTENGTKHQIWLEDKASMQRRVKLINDYHLGGAAAWYIGSETSDIWELYTF

SEQ ID NO: 2739 - protein, 481 aa, Bacillus sp.
MSKGAAASSVGTVKGDNVNVYRSPSLHSSVMQTVKKGEEFPVISSEAGDATQVTTHTVVPGNTLWLLAKQYGVTVSDLIKQNQLKKTELIPGQTLKIPPKGLLHKVVSGDTLWKVSVKYGVKANELTKLNQLSSTNIKPGQTLIIPDYYVQVQLLEGKKGWIKKSDLVQKKHQPVVMGWSFNEKTAGYTESMKQKNLDVVSPRGFTLTSNDKVVSSSINESYVQTAHKNGKKVWPLIGNNFDDVLTSDVLSNKAKRKKLVSSIESSLVKTNSDGINVDFENINIKNKQDFVLFIKELKAALKPHGMTISVDVTRENNDPFWSGSFDRKQIGQVADYVIMMGYEEHWGGSQVPGSVASLPWVKEGTQLLMKDVPAHKILLGVPFYTREWKTDLSTKKVVTKDLTMKEAEAVISSKKLAKKWDSQASQYYVEYTENGTKHQIWLEDKASMQRRVKLINDYHLGGAAAWYIGSETSDIWELYNF

SEQ ID NO: 2740 - protein, 481 aa, Bacillus sp.
MSKGAAASSVGTVKGDNVSVYRSPSLHSSVMQTVKKEEEFPVISSEAGDAAQVTTHTVVPGNTLWLLAKQYGVTVSDLIKQNQLKKTELIPGQTLKIPPKGLLHKVVSGDTLWKVSVKYGVKANELTKLNQLSSTNIKPGQTLIIPDYYVQVQLLEGKKGWIKKSDLVQKKHQPVVMGWSFNEKTAGYTESMKQKNLDVVSPRGFTLTSNDKVVSSSINESYVLTAHKNGKKVWPLIGNNFDDVLTSDVLSNKAKRKKLVSSIESSLVKTNSDGINVDFENINIKNKQDFVLFIKELKAALKPHGMTISVDVTRENNDPFWSGSFDRKQIGQVADYVIMMGYEEHWGGSQVPGSVASLPWVKEGTQLLMKDVPAHKILLGVPFYTREWKTDLSTKKVVTKDLTMKEAEAVISSKKLAKKWDSQASQYYVEYTENGTKHQIWLEDKASMQRRVKLINDYHLGGAAAWYIGSETSDIWELYNF

SEQ ID NO: 2741 - protein, 481 aa, Bacillus sp.
MSKGAAASSVGTVKGDNVNVYHSPSLHSSVMQTVKKEEEFPVISSEAGDAAQVTTHTVVPGNTLWLLAKQYGVTVSDLIKQNQLKKTELIPGQTLKIPPKGLLHKVVSGDTLWKVSVKYGVKANELTKLNQLSSTNIKPGQTLIIPDYYVQVQLLEGKKGWIKKSDLVQKKHQPVVMGWSFNEKTAGYTESMKQKNLDVVSPRGFTLTSNDKVVSSSINESYVQTAHKNGKKVWPLIGNNFDDVLTSDVLSNKAKRKKLVSSIESSLVKTNSDGINVDFENINIKNKQDFVLFIKELKAALKPHGMTISVDVTRENNDPFWSGSFDRKQIGQVADYVIMMGYEEHWGGSQIPGSVASLPWVKEGTQLLMKDVPAHKILLGVPFYTREWKTDLSTKKVVTKDLTMKEAEAVISSKKLAKKWDSQASQSYVEYTENGTKHQIWLEDKASMQRRVKLINDYHLGGAAAWYIGSETSDIWELYNF

SEQ ID NO: 2742 - protein, 481 aa, Bacillus sp.
MSKGDAASSVGTVKGDNVNVYRSPSLHSSVVQTVKKGEEFPAISSEAGDAAQVITHKVVLGNTLWLLAKQYGVTVSELIKQNQLKTTELTPGQTLKIPPKGLLHKVVSGDTLWKISVKYGVKATELTKLNQLSSTNIKPGQMLIIPDYYVQVQLLEGKKGWIKKSDLAQKKHQPVVMGWSFNEKTAGYAESMKQKNLDVVSPRWFTLTRSDKVVSSSINPSYVQTAHKNGKKVWPLIGNNFDDVLTSDVLGNKAKRQKLVSSVESSLVKTNSDGINVDFENINIKNKQDFVLFIKELKAALKPHGMTVSVDVTRENNDPFWSGSFDRKQIGQVADYVIMMGYEEHWGGSQVPGSVASLPWVKEGTELLMKDVPAHKILLGVPFYTREWKTDLSTKKVVTKDLTMKEAEAIISSKKLTKKWDSQASQYYVEYTENGTKHQIWLEDKASMQRRVKLINDYHLGGAAAWYIGSETSDIWELYNF

SEQ ID NO: 2743 - protein, 255 aa, Bacillus sp.
MKWCLSIIIIVSINFYGIQADAAKKSRFYYEKKGDIVWEVPMKDEKLIALTFDDGPDPKYTPTILNLLQKYGAKATFFVVGDRITSFPKLAQREVREGHELANHTYSHLKVRGQEVERIEQEIEKADERIQAIAGIKPYLFRPPTGYYDDRVVKAAKNQQYTIILWSWHQDTFDWRNPGVGKIVSQVLNHARSGDIVLFHDTGGDRTQTIEALKQILPKLKEEGYKFVTVSELLKHHPNYKSLYLMQQQKQHSVQ

SEQ ID NO: 2744 - protein, 255 aa, Bacillus sp.
MKWCLSIIIIVSINFYGIQADAAKKSRFYYEKKGDIVWEVPMKDEKLIALTFDDGPDPKYTPTILNLLQEYGAKATFFVVGDRVTSFPKLAQREVREGHELANHTYSHLKVRGQEVERIEQEIEKADERIQAITGIKPYLFRPPTGYYDDRVVKAAKNQQYTIILWSWHQDTFDWRNPGVGKIVSQVLNHARSGDIVLFHDTGGDRTQTIEALKQILPKLKEEGYKFVTVSELLKHHPNYKSLYLMQQQKQHSVQ

SEQ ID NO: 2745 - protein, 255 aa, Bacillus sp.
MKWCLSIIIIVSINFYGIQVDAAKKSRFYYERKGDIVWEVPMKDEKLIALTFDDGPDPKYTPTILNLLQKYGAKATFFVVGDRITSFPKLAQREVREGHELANHTYSHLKVRGQEVERIEQEIEKADERIQAITGIKPYLFRPPTGYYDDRVVKAAKNQQYTIILWSWHQDTFDWRNPGVDKIVSQVLNHARSGDIVLFHDTGGDRTQTIEALKQILPKLKEEGYKFVTVSELLKHHPNYKSLYLMQQQKQHSVQ

SEQ ID NO: 2746 - protein, 255 aa, Bacillus sp.
MKWCLSIIIIVSINFYGIQADAAKKSRFYYEKTGDIVWEVPMKDEKLIALTFDDGPDPKYTPTILNLLQEYGAKATFFVVGDRITSFPKLAQREVREGHELANHTYSHLKVRGQEVERIEQEIEKADERIQAITGIKPYLFRPPTGYYDDQVVKAAKNQQYTIILWSWHQDTFDWRNPGVGKIVSQVLNHARSGDIVLFHDTGGDRTQTIEALKQILPKLKEEGYKFVTVSELLKHHPNYKSLYLMQQQKQHTVQ

SEQ ID NO: 2747 - protein, 258 aa, Bacillus sp.
MKKGCLLLCALLFFTGASNGQAAKKSRFYYEKKGDIVWEIPTSEEKIIALTFDDGPDPTYTPLILDLLKEYNAKATFFVLGDRVTQYPTIAKREVKEGHELGNHTYSHLEVRGKDTVKIEGEIEKADDKIQQITGIKPYLFRPPTGYYDDKVVKAAKNQQYTVVLWSWHQDTFDWRNPGVDKIVHQVLKNASSGNIVLFHDTGGDRTQTVQALKQILPELKEKGYRFVTISELLKHHPNYESLYLMQKENKNKGTPLK

SEQ ID NO: 2748 - protein, 191 aa, Bacillus sp.
MFKKLAIIGALAVPMFGMSHGANAAETTHRVKAGETLYKIGAEYGVTVKQLKEANHKSTDSINANETLTIPNSISESDKELLARLVQAEAKGEPYAGKVAVATVVLNRVDSDSFPNSIHDVIYQGTQFTPVQNGEINKAADAEAKKAVNEALAFRGQGKGSLFFFNPDKTSDQWLRQKQVTITIGNHVFAK

SEQ ID NO: 2749 - protein, 191 aa, Bacillus sp.
MFKKLAIIGALAVPMFGMSHVANAAETTHRVKAGETLYKIGAEYGVTVEQLKEANHKSTDSINANETLTIPNSISESDKELLARLVQAEAKGEPYAGKVAVATVVLNRVDSDSFPNSIHDVIYQGTQFTPVQNGEINKAADAEAKKAVNEALAFRGQGKGSLFFFNPDKTSDQWLRQKQVTITIGNHVFAK

SEQ ID NO: 2750 - protein, 191 aa, Bacillus sp.
MFKKLAIIGALAVPMFGMSHVANAAETTHRVKAGETLYKIGAEYGVTVEQLKEANHKSTDSINANETLTIPNSISESDKELLARLVQAEAKGEPYAGKVAVATVVLNRVDSDSFPNSIHDVIYQGRQFTPVQNGEINKAADAEAKKAVNEALAFRGQGKGSLFFFNPDKTSDQWLRQKQVTITIGNHVFAK

SEQ ID NO: 2751 - protein, 191 aa, Bacillus sp.
MFKKLAIIGALAIPMFGMNHGANAAETTHRVKSGETLYKIGAEYGVTVKQLKEANHKSTDSINANETLTIPNSISESDKDLLARLVQAEAKGEPYAGKVAVATVVLNRVDSDSFPDSIHDVIYQGTQFTPVQNGEINKAADAEAKKAVNEALAFRGQGKGSLFFFNPDKTSDQWLRQKQVTITIGNHVFAK

SEQ ID NO: 2752 - protein, 191 aa, Bacillus sp.
MWKKLAIIGALTVSMLGLGHSASAAETTHRVDSGESLYKIGMEYGVSIKDLKAENNKETDALAINETLKIPSSISSTDKDLLARIIHAEAKGEPYAGKVAVATVILNRVDDDAFPNSIREVIYQKGQFEPVSNGEINKPADAEAKKAVNEALALHGGGSGSLFFFNPSKTDNQWLRQKEVTTTIGDHVFAK

SEQ ID NO: 2753 - protein, 410 aa, Bacillus sp.
MESVIRELLQVTFELQMSWEGMAYQRFFDEFFSKKRSMDGLVKHLHHTELELKKAAKTFREADEKAFGDFNQMGKLWDAFQRGSGKAAGDTIFDPLKKGWNKTSEFFENLVDNPMNALEDAKYGLTDFVESSIDDTKEEFRDKYEFMKDMWNNPIGTLKHELDEEVQEMYAIRNVLSDWYVENIKYGDAESITESVAYGATNLAFFGLITRGAGTVGNGARWGKNLSSMPKFQLENRLEPALAYGKIDYKVDTIKPSDTYMFAKTSSAVKRKTPGTVTLSFNLERSLGTQKKLMYNDGAIGIIPQEVREKLAGREFKSFDDFREEFWKTLANSSYAKEFNPMNIKLMKKGKAPYSPRTEHYGNHNKYILHHKQPIDKGGDVYNLDNLIIVSPKMHQNVLDPAYHFGNKGL

SEQ ID NO: 2754 - protein, 434 aa, Bacillus sp.
MGQVRVDPDKLEAAANSMSRNREAMERVIRELLQVTFELQMSWEGVAHQRFYDEFFSKKKSMDDLIKHLQHTELEVKKTAKTFREADEKAFGEFNQMGKLWDAFQRGSGRAAGDTLIDPLKKAGNQALDFFGHLVDDPIDALEEAKYGLTDFVESYVNDKKEKAKVTYEFIGDLWNDPIGTLKHEWNEEIQELYAIRNVLSDWYVKNIEYGDGESITESIAYGATNLAFFGLVTRGASAVGNGARWGKNLSSMSKFQLENHLEPALAYGKIDYKVDTIKPSDTYMFAKTSSAVKRKTPGTVTSSFNLERSLGTQKKLMYNDGAIGIIPQEVREKLAGREFKSFDDFREEFWKTLSDSSYAKEFSPMNIKLMKKGKAPYSPRTEHYGNHNKYILHHKQPIDKGGDVYNLDNLIIVSPKMHQNVLDPAYHFGNKGL

SEQ ID NO: 2755 - protein, 434 aa, Bacillus sp.
MGQVRVDPDKLEAAANSMSRNREAMERVIRELLQVTFELQMSWEGVAHQRFYDEFFSKKKSMDDLIKHLQHTELEVKKTAKTFREADEKAFGEFNQMGKLWDAFQRGSGRAAGDTLIDPLKKAGNQALDFFGHLVDDPIDALEEAKYGLTDFVESYVNDKKEKAKDTYEFIGDLWNDPIGTLKHEWNEEIQELYAIRNVLSDWYVKNIEYGDGESITESIAYGATNLAFFGLVTRGAGAVGNSARWRKYLSSMSTFQLENRLEPALAYGKIDYKVDTIKPLDTYMFAKTSSAVKRKTPGTVTSSFNLERSLGTQKKLMYNDGAIGIIPQEVREKLAGREFKSFDDFREEFWKTLSDSSYAKEFSPMNIKLMKKGKAPYSPRTEHYGNHNKYILHHKQPIDKGGDVYNLDNLIIVSPKMHQNVLDPAYHFGNKGL

SEQ ID NO: 2756 - protein, 434 aa, Bacillus sp.
MGQVRVDPDKLEASANSMSRNREDMERVIRELLQVTFELQMSWEGMANQRFFDEFFSKKRSMDDLVKHLHHTELELKKSARTFREVDEKAYGNFNLLSNLSDAFLRGSGRATGDTIFNPLKKAWKQTSGFFGHLVDNPMDAMEDAKYGLRDFVESSIDDTQEEFRDKYEFIKDMRKNPIGTLKHKWDEEFQEMHAMRNVMSDWYVENIEYGNAESITESIAYGATTLAFLGLVTRGTGAVGNGARWGRSLPSMSEFQLGSRLETAYAYGKMNYKIDTIKPLDTYWFAKTSSAVKRNTPGAVTSSFNLERSLGTQKKLMYNDGAIGVIPQEVREKLIGREFSSFDEFRKEFWKTVAESSYAEEFNRMNKMRMMEGKAPYTPESQQYGEHKVYVLHHKQPIHQGGDVYNLDNLIIVSPKTHQTILDPSYHFGKKGL

SEQ ID NO: 2757 - protein, 417 aa, Bacillus sp.
MSRNREDMERVIRELLQVTFELQMSWEGMANQRFFDEFFSKKRSMDDLVKHLHHTELELKKSARTFREVDEKAYGNFNLLSNLSDAFLRGSGRATGDTIFNPLKKAWKQTSGFFGHLVDNPMDAMEDAKYGLRDFVESSIDDTQEEFRDKYEFIKDMRKNPIGTLKHKWDEEFQEMHAMRNVMSDWYVENIEYGNAESITESIAYGATTLAFLGLVTRGTGAVGNGARWGRSLPSMSEFQLGSRLETAYAYGKMNYKIDTIKPLDTYWFAKTSSAVKRNTPGAVTSSFNLERSLGTQKKLMYNDGAIGVIPQEVREKLIGREFSSFDEFRKEFWKTVAESSYAEEFNRMNKMRMMEGKAPYTPESQQYGEHKVYVLHHKQPIHQGGDVYNLDNLIIVSPKTHQTILDPSYHFGKKGL

SEQ ID NO: 2758 - protein, 334 aa, Bacillus sp.
MIRKIVPFLAVLLVLSTLLNVTPAEASTKQDQLVTEAKKHIGVPYRWGGTTTSGFDCSGYMQYVFNQIGVSLPRTTGQMYNTGTSVSKSNLQVGDLVFFNTSGSGVSHAGIYIGSSQFIHSSSSRGVSIASINDPHYWGSRYIGAKRVLPEEKPQPVRVLGAGEYHDVATNHWAYSPIRNLSNQNIISGYGNDRFVPNDQLTRAQVAALLVRATGLATPTKTNAFSDVPESHWASADISAADRAGYFDYLPGSTFNPNEAVTRDEIAVLFAAAFELSASSSSSFPDVDSSNWAYNEISALKANGIVHGFADGTYRPNSNLTRAEFASILFQALN

SEQ ID NO: 2759 - protein, 129 aa, Bacillus sp.
MYSTTFNIGQINKAFVFFLAAAVLCGCGKADDSAAKKALPVTLHVEDADGSPAAGVTVTVMKAAESDHQPNIDRGEIIGKTDHHGEMTWKSGAKGTYAVVFEKDGVPETRNISLAESDKHTVISITLKH

SEQ ID NO: 2760 - protein, 129 aa, Bacillus sp.
MYSTTFNIGQINKAFVFFLAAAVLCGCGKADDSAAKKALPVTLHVEDADGSPAAGVTVTVMKAAESDHQPNIDRGEIIGKTDHHGEMTWKSSAKGTYAVVFEKDGVPETRNISLAESDKHTVISITLKH

SEQ ID NO: 2761 - protein, 129 aa, Streptococcus sp.
MYSTTFNIGQINKAFVIFLAAAVLCGCGKADDSAAKKAMPVTLHVEHADGSPAAGVTVTVMKAAESDHQPNIDRGEIIGKTDHHGEMTWKSGAKGTYAVVFEKDGVPETRNISLAESDKHTVISITLKH

SEQ ID NO: 2762 - protein, 129 aa, Bacillus sp.
MYSTTFNIGQINKAFVFFLAAAVLCGCGKADDSAAKKALPVTLHVEDADGSPAAGVTVTVMKAAESDHQPNIDRGEIIGKTDHHGEIAWKSGAKGTYAVVFEKDGVPETRNISLAESDKHTVISITLKQ

SEQ ID NO: 2763 - protein, 129 aa, Bacillus sp.
MYSTTFNIGQINKAFVFFLAAAVLCGCGKADDSAAKKALPVTLHAEDADGSPAAGVTVTVMKAAESDHQPNIDRGEIIGKTDHHGEIAWKSGVKGTYAVVFEKDGVPETRNISLAESDKHTVISITLKH

SEQ ID NO: 2764 - protein, 129 aa, Bacillus sp.
MYSTTFNIGQINKAFVFFLAAAVLCGCGKADDSAAKKALPVTLHVEDAEGSPAAGVTVTVMKAAESDHQPNIDRGEIIGKTDHHGEIAWKSGAKGTYAVVFEKDGVPETRNMSLAENDKHTVISITLKH

SEQ ID NO: 2765 - protein, 129 aa, Bacillus sp.
MYSTTFNIGQINKAFVFFLAAAVLCGCGKADDSAAKKVLPVTLHVEDAEGSPAAGVTVTVMKAAESDHQPNIDRGEIIGKTDHHGEIAWKSAAKGTYAVVFEKDGVPETRNMSLAENDKHTVISITLKQ

SEQ ID NO: 2766 - protein, 121 aa, Bacillus sp.
MYSTTFNIGQINKAFVFFLAAAVLCGCGKADDSAAKKALPVTLHVEDADGSPAAGVTVTVMKAAESDHQPNIDRGEIIGKTDHHGEIAWKSGAKGTYAVVFEKDGVPETRNISLARVINIR

SEQ ID NO: 2767 - protein, 130 aa, Bacillus sp.
MFSTTFNIGQINKVFIFFLAAAVLCGCGKADDSAAGKKTLPVTLHFEDADGSPADGVTVTVMKAAESDHQPNIDRGETIGKTDHHGNIAWKSGTEGTYAVVFEKDGIPETRNISLVESDKHTVISFTLKH

SEQ ID NO: 2768 - protein, 130 aa, Bacillus sp.
MFSTTFNIGQINKVFIFFLAAAVLCGCSKADDSAAGKKTLPVTLHFEDADGSPADGVTVTVMKAAESDDQPNIDRGEIIGKTDHHGNIAWKSGTEGTYAVVFEKDGIPETRNISLVESDKHTVISFTLKH

SEQ ID NO: 2769 - protein, 130 aa, Bacillus sp.
MFSTTFNIGQINKVFIFFLAAAVLCGCSKADDSAAGKKTLPVTLHFEDADGSPADGGTVTVMKAPESDHQPNIDRGEIIGKTDHHGNIAWKSGTEGTYAVVFEKDGIPETRDISLAESDKHTVISFTLKH

SEQ ID NO: 2770 - protein, 297 aa, Bacillus sp.
MAKRIFLFILTNLLVITTIGIVLTIITSVTGVGSYIQNGRIDLMALLVFSLVVGFVGSFISLGMSRWMAKTMMGVRVLNPKKQSLSYEEQQLIDRVHRLSRAAGMTKMPEVGIYQSPEVNAFATGPSKRRSLVAVSSGLLQQMDDAAVEGVLAHEVAHITNGDMVTMTLLQGIVNTFVVFLSRIAAWVASRFVKEDLAPVVHFIAMIVFQIIFSILGSLVVFAYSRHREFHADRGGADLAGKDKMIHALRTLKSYTGHVNEEDQTAVQTLKINGKKHSSLFSTHPDLDERIRRLEAK

SEQ ID NO: 2771 - protein, 297 aa, Bacillus sp.
MAKRIFLFILTNLLVITTIGIVLTIITSVTGVGSYIQNGRVDLTALLVFSLVVGFVGSFISLGMSRWMAKTMMGVRVLNPKKQSLSYEEQQLVDRVHRLARTAGMTKMPEVGIYHSPEVNAFATGPSKRRSLVAVSSGLLQQMDDAAVEGVLAHEVAHITNGDMVTMTLLQGIVNTFVVFLSRIAAWIASRFVKEDLAPVVHFIAMIVFQIIFSILGSLVVFAYSRHREFHADRGGADLAGKDKMIHALRTLKSYTGHVNEEDQTAVQTLKINGKKHSSLFSTHPDLDERIRRLEAK

SEQ ID NO: 2772 - protein, 297 aa, Bacillus sp.
MAKRIFLFILTNLLVITTIGIVLTIITSVTGVGSYIQNGRVDLTALLVFSLVVGFVGSFISLGMSRWMAKTMMGVRVLNPKKQSLSFEEQQLVDRVHRLARTAGMTKMPEVGIYHSPEVNAFATGPSKRRSLVAVSSGLLQQMDDAAVEGVLAHEVAHITNGDMVTMTLLQGIVNTFVVFLSRIAAWIASRFVKEDLAPVVHFIAMIVFQIIFSILGSLVVFAYSRHREFHADRGGADLAGKDKMIHALRTLKSYTGHVNEEDQTAVQTLKINGKKHSSLFSTHPDLDERIRRLEAK

SEQ ID NO: 2773 - protein, 298 aa, Bacillus sp.
MAKRIFLFILTNILVLTTIGIVLSILSSVTGVGTYFTADGGIDPMALLVFSLVVGFVGSFTSLAMSRWMAKTMMGVRVLNPKKHSLSYEEQQLVDRVHRLSRSAGLTKMPEVGIYRSPEVNAFATGPSKRRSLVAVSSGLLEQMDDAAVEGVLAHEVAHIANGDMVTMTLLQGIVNTFVVFLSRIAAWIASRFVKEDLAPIVHFIAMIVFQIIFSILGSLVVFAYSRHREFHADRGGADLAGKDKMIHALRTLKGYSSRMMEDDQTAVQTLKINGKKRSSLFSTHPDLDERIRRLEAK

SEQ ID NO: 2774 - protein, 298 aa, Bacillus sp.
MAKRIFLFILTNILVLTTIGIVLSVLSSVTGVGTYFTADGGIDPMALLVFSLVVGFVGSFTSLAMSRWMAKTMMGVRVLNPNKHTLSYEEQQLVDRVHRLSRSAGLTKMPEVGIYRSPEVNAFATGPSKRRSLVAVSSGLLEQMDDAAVEGVLAHEVAHIANGDMVTMTLLQGIVNTFVVFLSRIAAWIASRFVKEDLAPIVHFIAMIVFQIVFSILGSLVVFAYSRHREFHADRGGADLAGKDKMIHALRTLKSYSSRIIEDDQTAVQTLKINGKKRSSLFSTHPDLDERIRRLEAK

SEQ ID NO: 2775 - protein, 298 aa, Salinibacillus sp.
MAKRIFLFILTNILVLTTIGIVLSVISSVTGVGTYFTADGGIDPIALLVFSLVVGFVGSFMSLAMSRWMAKTMMGVRVLNPEKHTLSYEEQQLVDRVYRLSRSAGLTKMPEVGIYRSSEVNAFATGPSKRRSLVAVSSGLLDQMDDAAVEGVLAHEVAHIANGDMVTMTLLQGIVNTFVFFLSRIAAWIASRFVKEDLAPIVHFIAMIVFQIVFSILGSLVVFAYSRHREFHADRGGADLAGKDKMIHALRTLKGYSSRIMEEDQTAVQTLKINGKKRSSLFSTHPDLDERIRRLEAK

SEQ ID NO: 2776 - protein, 298 aa, Bacillus sp.
MAKRIFLFILTNILVLTTIGIVLSVLSSVTGVGTYFTADGGINPIALLVFSLVVGFVGSFTSLAMSRWMAKTMMGVKVLNPEKHTLSYEEQQLVDRVHRLSRSAGLTKMPEVGIYRSPEVNAFATGPSKRRSLVAVSSGLLEQMDDAAVEGVLAHEVAHIANGDMVTMTLLQGIVNTFVVFLSRIAAWIASRFVKEDLAPIVHFIAVIVFQIVFSILGSLVVFAYSRHREFHADRGGADLAGKDKMIHALRTLQSYSSRIKEDDQAAVQTLKINGKKHSSLFSTHPDLDERIRRLEAK

SEQ ID NO: 2777 - protein, 299 aa, Bacillus sp.
MGKRIFLFILTNILVITTIGIVLSIISATTGVGSYIGADGSLNIMYLLVFSAVVGFVGSFMSLAMSRWMAKMMMGVRVLNPEKDTLTYDEQQLVDRVHRLSRAAGLSKMPEVGIYQSSEVNAFATGPSKRRSLVAVSTGLLHEMDDAAVEGVIAHEVAHVANGDMVTMTLLQGIVNTFVVFLSRIAAWIASRFVSREELVPIVHFIAVIVFQIIFSILGSLVVFAYSRHREFHADRGGADLAGKDKMIHALRSLEAYTSRIKDDDQTAVATLKISGKRKASLFSTHPDLNERIRRLEAK

SEQ ID NO: 2778 - protein, 297 aa, Bacillus sp.
MGKRIFLFLLSNILVITTIGIVLSIIGSLTGVGTYFTAGGGINIVALLVFSAVVGFVGSFMSLLMSRWMAKMAMGVQVLNPDKQTLSYEEQQLVDRVYKLSRAAGLTKMPEVGIYNSREVNAFATGPSKNRSLVAVSTGLLQEMDDDAVEGVLAHEVAHIANGDMVTMTLLQGIVNTFVVFFARIAAWAVSRVVREELAPIVHFIAVIVFQIVFSILGSLVVFAYSRHREYHADRGGADLAGKDKMIHALRSLEQYTSRVKEEQASVATLKINGKKHTSLFSTHPDLSDRIRRLEAK

SEQ ID NO: 2779 - protein, 297 aa, Bacillus sp.
MGKRILLFLLSNILVITTIGIVLSIIGSLTGVGTYFTAGGGIHIGALLVFSAVVGFVGSFMSLSMSRWMAKMAMGVQVLNPEKQTLSYEEQQLVDRVHKLARAAGLTKMPEVGIYNSREVNAFATGPSKNRSLVAVSTGLLQEMDDDAVEGVLAHEVAHIANGDMVTMTLLQGIVNTFVVFFARIAAWAVSRVVREELAPIVHFIAVIVFQIAFSILGSLVVFAYSRHREYHADRGGADLAGKDKMIHALRSLQQYTSRIKEEQASVATLKISGKKHSSLFSTHPDLHDRIRRLEAK

SEQ ID NO: 2780 - protein, 292 aa, Bacillus sp.
MAKRIFLFILTNILVLITIGAVLSLLGVGSYVTASGGIDLISLLVFSAVVGFTGSFISLMMSKWMAKMMMGVKVLKPDQSLSDYERNLVDRVYRLSRAAGITKMPEVGIYQSREVNAFATGPSKNNSLVAVSTGLLEEMDDAAVEGVLAHEVAHISNGDMVTMTLLQGVVNTFVVFLARIAAWIASRFVREDMAPIVHFIAILIFQLLFSILGSLVVFAYSRHREFHADNGGADLAGKDKMVHALRTLKGYTQRINNEQSSVATLKISGKRGLALFSTHPDLDERIRRLEAK

SEQ ID NO: 2781 - protein, 293 aa, Bacillus sp.
MGKRIFYFLLTNILVLLTISIIFSVTGAGNYIDPQGNIDLGALLVFSAIIGFSGSFISLAMSRWMAKKMMNVRVLDPNKSLSAHEQEVVEKVHRLSKAAGLMHMPEVGIYDSPEVNAFATGPSKKRSLVAVSTGLLREMDDDAVEGVIAHEVAHIANGDMVTMTLLQGVVNTFVVFLARIAAWIASRFVKEDMAPIVHFIAVIVFQIVFSILGSLVVFAYSRHREYHADRGGADLAGKDKMVHALRMLKAYSNRVVEERDTAVATLKISGRRKSPIFSTHPDLDDRISRLEGR

SEQ ID NO: 2782 - protein, 292 aa, Bacillus sp.
MAKRIFFFILTNVLVLTTISIIFMVTGAGNYIQDGGINFGALLVFSAIVGFTGSFISLLMSRWMAKKMMNVKVIDPDGPMNSQERQIVEMVHRMSRAAGITKMPEVGIYYSPEVNAFATGPSKNRSLVAVSSGLLDEMDEAAVEGVIAHEVAHIANGDMVTMTLLQGVVNTFVVFLARIAAFIASRFVKEEMAPIVHFIAIIVFQIAFSILGSIVVFAFSRYREFHADRGGADLAGKDKMVHALRSLQAYTNRVTEEKDTAIASLKINGKRKSSLFSTHPDLNERIRRLEAK

SEQ ID NO: 2783 - protein, 292 aa, Bacillus sp.
MGKRIFLFLLTNVLVLVTISIVLSLTGAGNYFNAQGGIDLISLLIFSAIVGFTGALISLAMSRWMAKMMMKVKVLDPNASLSPMERTIVEKVHRLSRAARLTHMPEVGIYNSPEVNAFATGPSKKRSLVAVSTGLLHEMDDAAIEGVIAHEVAHIANGDMVTMTLLQGVVNTFVVFLARIAAWAVSRFVKEDIAPIVHFIAVIVFQIAFSILGSLVVFAYSRHREFHADSGGADLAGKDKMTHALQCLKAYSNRMKDEEQTAISTLKINGKRKSMLFSTHPDLDERINRLNR

SEQ ID NO: 2784 - protein, 296 aa, Cohnella sp.
MKRIFLFILTNLLVMVTIGIILSVVGVNSYINESGGINFQQLLIFSAIVGFTGAFISLAMSRWMAKMMMGVQVLDPRGSLSSGERELVDMVHQIARDAGMTVMPEVGIYESKEVNAFATGPSKRRSLVAVSTGLLEMMDRDAVEGIIGHEVAHIVNGDMVTMTLLQGVVNTFVVFLSRIAAWAASRFVKEDVAPLVHFIAVIVFQIVFSILGSLVVFAYSRHREFHADRGGAILAGKDKMIHALQSLQRYKERMVVGEQQTSVATLKIGGKPGRVSWFSTHPDLGDRIRALQEAQL

SEQ ID NO: 2785 - protein, 293 aa, Paenibacillus sp.
MGKRILLFILTNILVIVTIGIIFTILPIGSYITESGNIDFAALLVFSAVIGFTGAFISLAMSRWMAKKMMNVQVLDPQGPLNEHERELVDMVHRLSRSAGLTHMPEVGIYHAEEVNAFATGPSKKRSLVAVSTGLLQEMDRDAVEGVIAHEVAHVANGDMVTMTLLQGVVNTFVVFLSRIAAWIASRFVKEELAPIVHFIAVIVFQIAFSILGSLVVFAYSRHREYHADNGGAHLAGRDKMIHALQSLKAYTDRIKNEKDSSLATLKISGQKKSSLFSTHPALDDRIQRLQQG

SEQ ID NO: 2786 - protein, 292 aa, Bacillus sp.
MFKRIGLFILTNILVITTIGIVLSVLGVGNYITASGGIDLVTLLAFSAVVGFTGSLFSLAISRWMAKMMMGVQVLKPEDNLSPIERDLVERVHQLARTAGMRVMPEVGIYRSPEVNAFATGPSKNRSLVAVSTGLLEEMDEDAIDGVLAHEIAHIVNGDMVTMTLLQGIVNTFVVFLARVAAWAVSRFVREELAGVVHFIAILVFQILFSILGSLVVFAFSRYREYHADRGGADFAGKDKMIHALRSLQNYTQRTRDDDTSLATLKIISKRKRSIFSTHPDLQDRIARLEQR

SEQ ID NO: 2787 - protein, 422 aa, Bacillus sp.
MFVNTVIAFIIIFGTLVFFHELGHLLLAQRAGILCREFAIGFGPKIFSFKKNETVYTIRLLPVGGFVRMAGEDPEMIEVKPGYTVGLLFNKDDEVEKVIINQKEKYPDALIIEVETADLEHEMKITGYEQGKEDELAGFTVSQTSFFIVDGEEVQIAPYNRQFGSKPVWKRIKAIAAGPIMNFILAYVILVMLGFIQGVPSNQPELGKLTDNGRAAAAGLKEGDYIQSINGEKMRSWTDIVTAVKENPGKKIDVAVKRDGKSFHISVTPEAVKDENKKTIGRFGSYAPTEKGALAAIAYGATSTVDVTKAILTNLSKLVTGQFKLDMLSGPVGIYDMTDQVAKTGIINLFQFAAFLSINLGIVNLLPIPALDGGRLLFLFIEAIRGKPINRDKEAFVVFIGVAFLMLLMLVVTWNDIQRLFL

SEQ ID NO: 2788 - protein, 420 aa, Bacillus sp.
MNTVIAFIIIFGTLVFFHELGHLLLAQRAGILCREFAIGFGPKIFSFKKNETVYTIRLLPVGGFVRMAGEDPEMIEVKPGYTVGLLFNKDDEVEKVIINQKEKYPDALIVEVETADLEHEMKITGYEQGKEDELSGFTVSQTSFFIVDGEEVQIAPYNRQFGSKPVWQRIKAIAAGPIMNFILAYVILVMLGFIQGVPSNQPELGKLTDNGRAAAAGLKEGDYIQSINGEKMRSWTDIVTAVKDNPGKKIDVAVKRDGKSFHISVTPEAVKDENKKTIGRFGSYAPTEKGAFVAIAYGATSTVDVTKAILTNLSKIVTGQFKLDMLSGPVGIYDMTDQVAKTGIINLFQFAAFLSINLGIVNLLPIPALDGGRLLFLFIEAIRGKPINRDKEAFVVFIGVAFLMLLMLVVTWNDIQRLFL

SEQ ID NO: 2789 - protein, 407 aa, Bacillus sp.
MNTVIAFIIIFGTLVFFHELGHLLLAQRAGILCREFAIGFGPKIFSFKKNETVYTIRLLPVGGFVRMAGEDPEMIEVKPGYTVGLLFNKDDEVEKVIINQKEKYPDALIIEVETADLEHEMKITGYEQGKEDELAGFTVSQTSFFIVDGEEVQIAPYNRQFGSKPVWKRIKAIAAGPIMNFILAYVILVMLGFIQGVPSNQPELGKLTDNGRAAAAGLKEGDYIQSINGEKMMSWTDIVTAVKENPGKKIDVAVKRDGKSFHISVTPEAVKDENKKTIGRFGSYAPTEKGALAAIAYGATSTVDVTKFKLDMLSGPVGIYDMTDQVAKTGIINLFQFAAFLSINLGIVNLLPIPALDGGRLLFLFIEAIRGKPINRDKEAFVVFIGVAFLMLLMLVVTWNDIQRLFL

SEQ ID NO: 2790 - protein, 420 aa, Bacillus sp.
MNTVIAFIIIFGTLVFFHELGHLLLAQRAGILCREFAIGFGPKIFSFKKNETVYTIRLLPVGGFVRMAGEDPEMIEVKPGYTVGLLFNKEDQVEKVIINQKEKYPDALVIEVETADLEHDMKITGYEQGKEDELSSFTVSETSFFMVDGEEVQIAPYNRQFGSKPVWQRIKAIAAGPIMNFILAYVILVMLGLIQGVPSNEPMLGQLTDNGRAAEAGLKEGDYIQSINGEKMRSWTDIVSAVKENPEKEMDVAVKRDNKTLHISVTPEAVKDENKKTIGRFGSYAPTEKGVLSAVAYGATSTVDVTKAILTNLSKLVTGQFKLDMLSGPVGIYDMTDQVAKTGIVNLFQFAAFLSINLGIVNLLPIPALDGGRLLFLFIEAIRGKPINREKEAFVVFIGVAFLMLLMLVVTWNDIQRLFL

SEQ ID NO: 2791 - protein, 420 aa, Bacillus sp.
MNTVIAFIIIFGTLVFFHELGHLLLAQRAGILCREFAIGFGPKIFSFKKNETVYTIRLLPVGGFVRMAGEDPEMIEVKPGYTVGLLFNKEDQVEKVIINQKEKYPDALVIEVETADLEHDMKITGYEQGKEDELSSYTVSETSFFIVDGEEVQIAPFNRQFGSKPVWQRIKAIAAGPIMNFILAYVILVMLGLVQGVPSNDPVLGQLTDNGRAAEAGLKEGDYIQSINGEKMKSWTDIVSAVKENPEKEMDVAVKRDNKTLHISVTPEAVKDENKKTIGRFGSYAPTEKGVLSAVAYGATSTVDVTKAILTNLSKLVTGQFKLDMLSGPVGIYDMTDQVAKTGLVNLFQFAAFLSINLGIVNLLPIPALDGGRLLFLFIEAIRGKPINREKEAFVVFIGVAFLMLLMLVVTWNDIQRLFL

SEQ ID NO: 2792 - protein, 420 aa, Bacillus sp.
MNTVIAFIIIFGTLVFFHELGHLLLAQRAGILCREFAIGFGPKIFSFKKNETVYTIRLLPVGGFVRMAGEDPEMIEVKPGYTVGLLFNKEDQVEKVIINQKEKYPDALVIEVETADLEHDMKITGYEQGKEEELSSFTVSQTSFFIVDGEEVQIAPYNRQFGSKPVWQRIKAIAAGPIMNFILAYVILVMLGLMQGVPSNEPVLGKLTDDGRAAVSGLKEGDYIQSINGEKMRSWTDIVSAVKKNPDKEMDVAVKRDNKTLHISVTPEAVKDENKKTVGRFGSYSPTEKGVLASIVYGATSTVDVTKAILTNLGKLVTGQFKIDMLAGPVGIYDMTDQVAKTGLINLFRFAAFLSINLGIVNLLPIPALDGGRLLFLFVEAIRGKPINRDKEAFVVFIGVAFLMLLMLVVTWNDIQRLFL

SEQ ID NO: 2793 - protein, 420 aa, Bacillus sp.
MNTVIAFIIIFGTLVFFHELGHLLLAQRAGILCREFAIGFGPKIFSFKKNETVYTIRLLPVGGFVRMAGEDPEMIEVKPGYTVGLLFNKEDQVEKVIINQKEKYPDALVIEVETADLEHDMKITGYEQGKEDELSSFTVSETSFFIVDGEEVQIAPYNRQFGSKPVWQRIKAIAAGPIMNFILAYVILVMLGLIQGVPSNEPMLGQLTDNGRAAEAGLKEGDYIQSINGEKMRSWTDIVSAVKENPEKEMDVAVKRANKTLHISVTPEAVKDENKKTIGRFGSYAPTEKGVLSAVAYGATSTVDIGNQILETFGNLVTGQFKINMLAGPVGIYDMTDQVAKTGLVNLVRFAAFLSINLGIVNLLPIPALDGGRLLFLFIEAIRGKPINREKEAFVVFIGVAFLMLLMLVVTWNDIQRLFL

SEQ ID NO: 2794 - protein, 419 aa, Bacillus sp.
MNTVIAFILIFGTLVFFHELGHLILAQRAGILCREFAIGFGPKIFSFKKNETVYTIRLLPIGGFVRMAGEDPEMIEVKPGYTVGLLFDSENKVEKIIINQKEKYPDALVIEVEQADLEHQMRITGYEHGNEDHLSSFSVSETSFFIVDGEEVQIAPYNRQFHSKTVWQRIKAIAAGPIMNFILAYVILVMLGLMQGVPSDEPVLGKLIDNGRAAEAGLQEGDRIQTINGENMRSWTDIVNTVREHPEKELKIVLMRDNVKLTKYVTPEAVKAGDETVGRFGAYNPVKTGVLTSISYGATETATVAQSIVTNLGKLVTGQFSIDMLAGPVGIYDMTDQVARTGVINLLKLAAFLSINLGIVNLLPIPALDGGRLLFLFIEAIRGKPINREKEAFVVFIGVAFLMLLMLVVTWNDIQRLFL

SEQ ID NO: 2795 - protein, 354 aa, Bacillus sp.
MAGEDPEMIEVKPGYTVGLLFNKEDQVEKVIINQKEKYPDALVIEVETADLEHDMKITGYEQGKEDELSSFTVSQTSFFIVDGEEVQIAPYNRQFGSKPVWQRIKAIAAGPIMNFILAYVILVMLGLIQGVPSNEPVLGQLTDNGRAAEAGLKEGDYIQSINGEKMRSWTDIVSAVKENPEKEMDVAVKRNNKTLHIAVTPEAVKDENKKTIGRFGSYAPTEKGVLSAVAYGATSTVDVTKAILTNLSKLVTGQFKLDMLSGPVGIYDMTDQVAKTGLVNLFQFAAFLSINLGIVNLLPIPALDGGRLLFLFIEAIRGKPINREKEAFVVFIGVAFLMLLMLVVTWNDIQRLFL

SEQ ID NO: 2796 - protein, 419 aa, Bacillus sp.
MNTVIAFIIIFGTLVFFHELGHLIMAQRAGILCREFAIGFGPKIFSFKRKETVYTIRLLPIGGFVKMAGEDPEVIEIKPGHTVGLLFNEQNEVEKIILNDKEKYPDALVIEVEQIDLDHAMRISGYEAGNEDILTGYNVSQTSFYIADGEEIQIAPYNRQFGSKTVWQRIKAIAAGPIMNFILAYVILVALGFIQGVTVDDPVLGKLTKDGRAAQAGLMQGDHIVSINGDKMNSWTDVVQTVQKNPDKKMNVVIDRDGKESTIQVVPEAVKAEGKTIGRFGSYPPTENGFLKVISSSGTTVISTAGLILTNLQKIVTGQFSLDMLAGPVGIYDMTGEVAKQGVLTLMQFAAFLSINLGIVNLLPIPALDGGRLLFLFVEAIRGKPINREKEALVVFIGVAFLMLLMLVVTWNDIQRLFL

SEQ ID NO: 2797 - protein, 419 aa, Bacillus sp.
MNTVIAFIIIFGTLVFFHELGHLIMAQRAGILCREFAIGFGPKIFSFKRKETVYTIRLLPIGGFVKMAGEDPEVIEIKPGHTVGLLFNEQNEVEKIILNDKEKYPDALVIEVEQIDLDHAMRISGYEAGNEDILTGYNVSQTSFYIADGEEIQIAPYNRQFGSKTVWQRIKAIAAGPIMNFILAYVILVALGFIQGVTVDDPVLGKLTKDGRAAQAGLMQGDEIVSINGDKMNSWTDVVQTVQKNPEKKMNVVIDRDGKESTVQVVPEAVKADGKNIGRFGSYPPTENGFLKVISSSGTTVISTAGLILTNLQKIVTGQFSLDMLAGPVGIYDMTGEVAKQGVLTLMQFAAFLSINLGIVNLLPIPALDGGRLLFLFVEAIRGKPINREKEALVVFIGVAFLMLLMLVVTWNDIQRLFL

SEQ ID NO: 2798 - protein, 421 aa, Bacillus sp.
MFVNTVIAFIIIFGTLVFFHELGHLIMAQRAGILCREFAIGFGPKIFSFKRKETVYTIRLLPIGGFVKMAGEDPEVIEIKPGHTVGLLFNEQNEVEKIILNDKEKYPDALVIEVEQIDLDHAMRISGYEAGNEDILTGYNVSQTSFYIADGEEIQIAPYNRQFGSKTVWQRIKAIAAGPIMNFILAYVILVALGFIQGVTVDDPVLGKLTKDGRAAEAGLMQGDHIVSINGDKMDSWTDVVQTVQKNPEKKMNVVIDRDGKESTVQVVPEAVKADGKNIGRFGSYPPTENGFLKVISSSGTTVISTAGLILTNLQKIVTGQFSLDMLAGPVGIYDMTGEVAKQGVLTLMQFAAFLSINLGIVNLLPIPALDGGRLLFLFVEAIRGKPINREKEALVVFIGVAFLMLLMLVVTWNDIQRLFL

SEQ ID NO: 2799 - protein, 103 aa, Bacillus sp.
MAKESIIFVGLFTAILSAAILLVSCAGNDHSLSQYVKIKVQDGDTLWSLADHVAEKKHINKEDFIEWVTENNHLQTADIKPGDELILPVKKKHPAVYQLAIVN

SEQ ID NO: 2800 - protein, 103 aa, Bacillus sp.
MAKESIIFVGLFTAILSAAILLVSCAGNDQTLSQYVKIKVQDGDTLWSLADHVAEKKNINKEDFIEWVTENNHLQTADIKPGDELILPVKKKHPAVYQLAIVN

SEQ ID NO: 2801 - protein, 103 aa, Bacillus sp.
MAKESIIFVGLFTAILSAVILLVSCAGNDQALSQYVKIKVQDGDTLWSLADQVAEKKNINKEDFIEWVTENNHLQTADIKPGDELILPVKKEHPAVYQLAIVN

SEQ ID NO: 2802 - protein, 215 aa, Bradyrhizobium sp.
MPSSQPIRQARPWLAFLLLLAGSGAAPAAPLPTASLHVGTTYARWLWPVQAVRGQTNTASVSLQIRPSETVNVGGKVSFGVTARKTGYLILVDVDAEGRMSQIFPTPELLAQSNERDINLVKPGVEFVVPAPAARQRGFEYIVAPPTGSAVMIAILSERRVQLLDLPDMPRKLEGQADALSYLSAWTSELRVPDSSSGKLVTNNWSFDVKSYSIK

SEQ ID NO: 2803 - protein, 215 aa, Mesorhizobium sp.
MPSSQSIRRKRAWFAFLLLQAGSGPASAAPLPTGALHIGTTYVPWLWPAQAVRRQTNTASVSLQILPSQTVNVGAKVSFGVTARRPGYLILVDVDSEGRMSQIFPTPELLAQSNERDINLVKPGVEFVVPAPAARQRGFEYVVAPPTGSAVMIAILSELRVQLLDLPDMPRKLEGQADALSYLSAWTSELRVPDNSSGKLVTNNWSFDVKSYSIK

SEQ ID NO: 2804 - protein, 215 aa, Bradyrhizobium sp.
MPSSQPIRRERPWLAFLLLLAGSGASSAAPLPSASLNVGTTYAPWLWPVQAARRQANTASVSLQILPGQTVNLGGKVTFGVTARKPGYLILVDVDAEGRMSQIFPTPELLAQSDGRDINLVKPGVEFVVPTPAARQRGFEYVVSPPTGSAVMIAILSERRVQLLDLPDLPRKLQDQAEALSYLTAWTSELRVPDNGSGKLVTNNWSFDVKSYSIK

SEQ ID NO: 2805 - protein, 215 aa, Bradyrhizobium sp.
MPSSQPIRRGRPWLAFLLLLAGSGASCAAPLPSASLNVGTTYAPWLWPVQAARRQANTASVSLQILPGQTVNLGGKVTFGVTARKPGYLILVDVDAEGRMSQIFPTPELLAQSDGRDINLVRPGVEFVVPTPAARQRGFEYVVSPPTGSAVMIAILSERRVQLLDLPDLPRKLQDQAEALSYLTAWTSELRVPDSGSGKLVTNNWSFDVKSYSIK

SEQ ID NO: 2806 - protein, 220 aa, Bradyrhizobium sp.
MWRSELIRRKRVCFAFALLLAGSGAAPAAPLRPESLHASLASAPWSWRIQATRGQSSAAQSNAASVSLEILPSLTVNVGGKVSFGVTAKKAGYLILVDVDADGRMSQIFPTPELLEQSDGRDINLVKPGVQFVVPTPAGRQRGFEYVVAPPTGSAVMVAILSERRVQLLDLPDLPRKLQNQADTLSYLSAWTSELRVPDGGSGKLVPNNWSFDVKSYSIK

SEQ ID NO: 2807 - protein, 216 aa, Bradyrhizobium sp.
MPRSKQIRQARSWLSVLLLMVASVGSVSAAPLSLRSPHLSMANTPWLLPVQAQRGQANTASVSLEIRPSQTVNVGSKVSFGVNARKPGYLLLVDVDAEGRMSQIFPTPELLAQSDGRDINLVKPGVEFVVPTPAAQQRGFEYVVSPPGGTAVIVAILSERRVQLLDLPDLPRKLQGQAEALSYLSAWTRELRVPDGDSGKLVSNVWSFDIKSYSIK

SEQ ID NO: 2808 - protein, 220 aa, Bradyrhizobium sp.
MWRSELIRRKRVCFAFALLLAGSGAAPAAPLWPESLHASLASAPWFWHIQATRGQSSAAQSNAASVSLEILPSLTVNVGGKVSFGVTAKKAGYLILVDVDADGRMSQIFPTPELLEQSDGRDINLVKPGVQFVVPTPSGRQRGFEYVVAPPTGSALMVAILSERRVQLLDLPDLPRKLQNQADTLSYLSAWTRELRVPDGGSGKLVPSNWSFDVKSYSIK

SEQ ID NO: 2809 - protein, 214 aa, Bradyrhizobium sp.
MSPAELVCRKQSWFAFVLLLAGSGAASAAPPPSASSAGATNAPLLWRVQAPRGPANAAGVSLEILPGPTVNIGGKVSFGVTARKPGYLMLVDVDAEGRMSQIFPTAELLAQSVGPDMNLVKPGVQFIVPTPAAQQRGFEYVVAPPAGSAVIVAILSERRVQLLDLPDIQRKLQGPADTLSYLSDWTSQLRIPDSGGGRLLPNNWSFDIKSYSIK

SEQ ID NO: 2810 - protein, 215 aa, Bradyrhizobium sp.
MSPAELVCRKQSWLAIVLVLAGSEVACAAPLPSASPSAGATNAQSVRRVQAPRSPANAASVSLEILPGPTVNIGSKVSFGVTARKPGYLMLVDVDAEGRMSQIFPTAELLAQSVGADMNLVKPGVQFIVPTPAAQQRGFEYVVAPPAGSAVIVAILSERRAQLLDLPDIQRKLQGPADTLSYLSDWTSQLRVPDSGSGKLVPNNWSFDIKSYSIK

SEQ ID NO: 2811 - protein, 82 aa, Bradyrhizobium sp.
MITKKLLAAVGVVSLLAVPAMADSTDKEKNGHHYSGGPKTEVPHHMGKKTTSGSSAKTSSGGHHYTGGPNTSSPHHMGDKTK

SEQ ID NO: 2812 - protein, 83 aa, Bradyrhizobium sp.
MITKKFLAAVGILSLLAVPAMAQTTDKEKNGHHYSGGPKTEVPHHMGKKETVGSSKGSTSAGHHYTGGPSTSAPHHMGEKKDQ

SEQ ID NO: 2813 - protein, 80 aa, Bradyrhizobium sp.
MITKKLLAAIGIVSLLAVPAMAQTTDKEKNGHHYSGGPKTEVPHHMGKKETVGVSKDGASGGHHYTGGPASSPHHMGDKK

SEQ ID NO: 2814 - protein, 81 aa, Bradyrhizobium sp.
MITKTLLAAVTAALIALPAVAQTADKEKNGHHYSGGPKTEVPHHMGPKEAVGSSKKTTSGGHHYTGGPSTSNPHHMGDKDK

SEQ ID NO: 2815 - protein, 81 aa, Bradyrhizobium sp.
MIIRTLFAAITAASLAVPATAQTADKEKNGHHYSGGPKTEVPHHMGPKDTAGSSKKTTSGGHHYTGGPSTSNPHHMGDKDK

SEQ ID NO: 2816 - protein, 113 aa, Brevibacillus sp.
MFYNPYDYNPHYDDPYHYVEVQHRVNRFFEHIDGNGASFTLNSGERLSYVGDAWNDRISSVRVAPKTLVVLYEHINFTGRKKLLENSSNRSHLFNIHEDFNDITSSIKTFRLC

SEQ ID NO: 2817 - protein, 113 aa, Brevibacillus sp.
MFYNPYDYNPHYDDPYHYVEVQHRVNRFFEHIDGNGASFTLNSGDRLSYVGDAWNDRISSVRVAPKTLVVLYEHINFTGRKKLLENSSNRSHLFNIHEDFNDITSSIKTFRLC

SEQ ID NO: 2818 - protein, 138 aa, Brevibacillus sp.
MSWRKSTLFGGSGGSPFNDDHTDVKRLAGFYIRHGSRIDAIQGIYDYLDGRRAPQEFHGGNGGTQAIVFFEDDEYIIRITGRTGSRVDQLTITTNKRTYGSYGGNGGSPFEIDAANIGGFFGRSGSEIDAIGFFIPTS

SEQ ID NO: 2819 - protein, 317 aa, Brevibacillus sp.
MKKFASLILISVFLFSSTQFVHASSTDVQERLRDLARENEAGTLNEAWNTNFKPSDEQQFSYSPTEGIVFLTPPKNVIGERRISQYKVNNAWATLEGSPTEVSGTPLYAGKNVLDNSKGTMDQELLTPEFNYTYTESTSNTTTHGLKLGVKTTATMKFPIAQGSMEASTEYNFQNSSTDTKTKQVSYKSPSQKIKVPAGKTFRVLAYLNTGSISGEANLYANVGGIAWGVLPGYPNGGGINIGAVLTKCQQKGWGDFRNFQPSGRDVIVKGQGTFKSNYGTDFILKIEDITDSKLRNNNGSGTVVQEIKVPLIRTEI

SEQ ID NO: 2820 - protein, 317 aa, Brevibacillus sp.
MKKFASLILISVFLFSSTQFVHASSTDVQERLRDLARENEAGTLNVAWNTNFKPSDEQQFSYSPTEGIVFLTPPKNVIGERRISQYKVNNAWATLEGSPTEVSGTPLYAGKNVLDNSKGTSDQELLTPEFNYTYTESTSNTTTHGLKLGVKTTATMKFPIAQGSMEASTEYNFQNSSTDTKTKQVSYKSPSQKIKVPAGKTYRVLAYLNTGSISGEANLYANVGGIAWGVLPGYPNGGGINIGAVLTKCQQKGWGDFRNFQPSGRDVIVKGQGTFKSNYGTDFILKIEDITDSKLRNNNGSGTVVQEIKVPLIRTEI

SEQ ID NO: 2821 - protein, 317 aa, Brevibacillus sp.
MKKFASLILISVFLFSSTQFVHASSTDVQERLRDLARENEAGTLNEAWNTNFKPSDEQQFSYSPTEGIVFLTPPKNVIGERRISQYKVSNAWATLEGSPTEVSGTPLYAGKNVLDNSKGTMDQELLTPEFNYTYTESTSNTTTHGLKLGVKTTATMKFPIAQGSMEASTEYNFQNSSTDTKTKQVSYKSPSQKIKVPAGKTYRVLAYLNTGSISGEANLYANVGGIAWGVLPGYPNGGGINIGAVLTKCQQKGWGDFRNFQPSGRDVIVKGQGTFKSNYGTDFILKIEDITDSKLRNNNGSGTVVQEIKVPLIRTEI

SEQ ID NO: 2822 - protein, 836 aa, Burkholderia sp.
MNRTLLLKAALIAAAVLPAAAGAQSAQTFNAPMPGAPATPGAQARPPGGILSPFLLSAQLGRDLMLHYAIDNNNANAAGVPCADLGADSASCATGRLILENRGQARISGDGWKLYLHSIRRLLRIDHPGFTLRHLTGDLYELTPKPGAVTLAPGARLTVPFVAEYWFLRYSDLLPRPYVIVSGALPTVLRHNDTDDETRYVDSLPADAQSSSTGNAPPAAVQPVASRALPSVKRERLGNDTVELRGVQLALTGLAANHVAALRERAGELGLGGSGLPVRGSIVPQQLPADIAIPGGYRLSITRQGANIEAYDQTGLYYGVQTLFSLTPAGGGRIPAMQVEDAPRFPHRGMHADLARNFKHADTLRKLIDQMSAYKLNRLHLHLSDDEGWRIEIPGLPELTAVGSRRCHDPSETLCLLPQLGSGPDNRSGGGYLRRDEYVSLLRYAAERFVDVIPEIDMPAHARAAVQSMEVRYRLFHALGREREASEYRLVDPQDTSNTLSVQFYDRRSYLNPCAPGSLKFATKVIREIAAMYADAQAPLPIWHFGGDEAKNILLGAGFQPLNGTDPNKGRVDQAAQDLPWARSPMCTALLQRGEIKSTEELPTRFAQQVSAQVAANGIGTMAAWQDGLKHANGPQDFSTRNTMVTLWDTLFWGAADSARDWSAKGYRTVLALPDYLYFDFPYTTNPRERGYYWGSHATDEYKVFSFAPENLPQNAEVIGDRDGNPFEVTGTGAAPRLEGMQGQAWGEVMRNDSEFEYMVYPRLLALAERAWHRADWERPYAAGVRYKLGDTHLVDKDALNKDWAGFATVLKQRELPKLGRAGIGYRSPTFSLSGS

SEQ ID NO: 2823 - protein, 836 aa, Burkholderia sp.
MNRTLLLKAALIAAAVLPAAAGAQSAQTFNAPMPGAPATPGAQARPPGGILGPFLLSAQLGRDLMLHYAIDNNNANAAGVPCADLGADSASCATGRLILENRGQARISGDGWKLYLHSIRRLLRIDHPGFTLRHLTGDLYELTPKPGAVTLAPGARLTVPFVAEYWFLRYSDLLPRPYVIVSGALPTVLRHNDTDDETRYVDSLLADAQSSSTGNAPPATVQPVASRALPSVKRERLGNDTVELRGVQLALTGLAANHVAALRERAGELGLGGSGLPVRGSIVPQQLPADIAIPGGYRLSITRQGANIEAYDQTGLYYGVQTLFSLTPAGGGRIPAMQVEDAPRFPHRGMHADLARNFKHADTLRKLIDQMSAYKLNRLHLHLSDDEGWRIEIPGLPELTAVGSRRCHDPSETLCLLPQLGSGPDNRSGGGYLRRDEYVSLLRYAAERFVDVIPEIDMPAHARAAVQSMEVRYRLFHALGREREASEYRLIDPQDTSNTLSVQFYDRRSYLNPCAPGSLKFATKVIREIAAMYADAQAPLPIWHFGGDEAKNILLGAGFQPLNGTDPNKGRVDQAAQDLPWARSPMCTALLQRGEIKSTEELPTRFAQQVSAQVAANGIGTMAAWQDGLKHANGPQDFSTRNTMVTLWDTLFWGAADSARDWSAKGYRTVLALPDYLYFDFPYTTNPRERGYYWGSHATDEYKVFSFAPENLPQNAEVIGDRDGNPFEVTGTGAAPRLEGMQGQAWGEVMRNDSEFEYMVYPRLLALAERAWHRADWERPYAAGVRYKLGDTHLVDKDALNKDWAGFATVLKQRELPKLGRAGIGYRSPTFSLSGS

SEQ ID NO: 2824 - protein, 831 aa, Burkholderia sp.
MNRLIPSIVAGLLVAALPACATFAQSAPPAPAAPPAAAAAAASPAVSPAELAAVLSNGLALRVAVDNNHAAAAGVPCADLGADGAACATGRLILQNRGHRTIAAAGWRLYLHSIRRLLRIDRPGFALRRLTGDLYALTPQPGALRLAPGERVELPFVAEYWLRRYSDVIPRPYVVVDGAPPAVLRYNDTDDELRYVESLPADAQNSSTGNAPPVAARPDPSRALPSVKRQQMLAGALELRGVELALSDLPAAQVAALRERATTLGLDGTRVPVRGAVEPRRLPADIATPGGYRLAIGPRGALIEGYDRAGLYYGVQTLFSLVPAGGGTIPAMLIDDAPRFVHRGMHVDLARNFKHPATLRRLIDQMSAYKLNRLHLHLSDDEGWRIEIPGLPELTDVGARRCHDPSETRCLLPQLGSGPDNRSGGGYLTRDDYVALVRYAADRFVEVIPEIDMPAHARAAVVSMEARYRRLHAAGREQEANAYRLLDPQDTSNLLTVQFYDRRSDLNPCVPGALNFATKVIREIASMHADAQVPLRIWHFGGDEAKNILLGGGFQPLNGTDPNKGRIDLAAQDKPWARSPACTALLQRGEIKSIDELPTRFAKQVSAIVAANGIGTMAAWQDGIKHANGPQDFSTRRVMVSLWDTIFWGASDSARDLGNRGYLTVLALPDYLYFDFPYTLNPRERGYYWGSQATDEYKVFSLAPENLPQNAEVIGDRDGNAFEVTGTGAAPRIEGIQAQAWGEVMRNDTFLEYMVYPRLLALAERAWHRADWELPYTAGVRYKRGDTHHVDTAALQRDWAGFATLLKQRELPKLDRAGIGYRKPTFTVTGE

SEQ ID NO: 2825 - protein, 827 aa, unknown
  environmental sample
MSRTLSTLFAGVLIAALPPVALGALPASSAAVAAAGAVRPPVPPADLAARLSNGLALRVAVDNNHAASAGVPCADLGADGAACATGRLILQNRGHQAIADGGWKLYLHSIRRLLRIDRPGFALRRLTGDLYELTPQPGSVRLAPGERIELPFVAEYWLLRYSDVIPRPYVVVEGAPPAVLRYDDTDDELRYVESLPADAQNNSTGNAPPVAARPDPSRALPSVKREQPLPGTLELRGVELALPDLPDAQVAALRERATTLGLDGARVPVRGAVAPRRLPADIATPGGYRLAIGPRGVLIEGYDRAGLYYGVQTLYSLAPAGGGPIPAMLVEDAPRFTHRGMHVDLARNFKHPATLRRLIDQMSAYKLNRLHLHLSDDEGWRIEIPGLPELTGIGSRRCHDPSETRCLLPQLGSGPDNRSGGGYLTRDDYVALVRYAAAHFVEIVPEIDMPAHARAAVVTMEARYRRLHAAGREQEANAYRLLDPQDTSNLTTVQFYDRRSDLNPCVPGALNFASKVIREIAAMHADAQAPLHIWHYGGDEAKNIFLGAGFQPLNGTDPNKGRIDLAAQDKPWARSPACTALLQRGEIKSIDELPTRFAQQVSAAVSANGIDTMAAWQDGIKHANGPQDFSTRHVMVSLWDTIFWGASDSARDLSGKGYLTVLALPDYLYFDFPYTLNPRERGYYWGSHATDEYKVFSLAPENLPQNAEVMGDRDGNPFEVTGTGPAPRIEGMQGQAWGEVMRNDTFLEYMAYPRLLALAERAWHRADWELPYAAGVRFKRGDTHHVDTAALQRDWAGFATLLTQRELPKLDRAGVGYRKPTFTLTNP

SEQ ID NO: 2826 - protein, 827 aa, Burkholderia sp.
MKSTLPSLLTGLLIAALLPAATCAAPVQTAAGAIAGTARAAMQPADLAALLSNGLALRVSVDNNHAAAAGVPCADLGADGAACATGRLFLQNRGHQPIADGGWKLYLHSIRRLLRIDRPGFALRRLTGDLYELTPQPGSVRLAPGERIELPFVAEYWVRRYSDVIPRPYVVVDGAPPAVLRYNDTDNELRYVESLPADAQNNSTGNAPTVAARPDASRALPSVKREQPLPGALDLRGVELLLAGMPDAQVAALRERATTLGLDGARVPVLGAVAPRRLPADIATPGGYRLAIGPRGVLIEGYDRAGLYYGVQTLFSLAPAGGGTIPALLIEDAPRFTHRGMHVDLARNFKQPATLRRLIDQMSAYKLNRLHLHLSDDEGWRIEIPGLPELTDIGARRCHDPSETRCLLPQLGSGPDNRSGGGYLTRADYVALVRYAADRFIDVIPEIDMPAHARAAVVSMEARYRRLHAAGRDQDANAYRLLDPQDTSNLTTVQFYDRRSDLNPCVPGALNFASKVIREIATMHADAQAPLRIWHYGGDEAKNILLGGGFQPLNGTDPNKGRVDLAAQDKPWARSPACTALLQRGEIKSIDELPTRFAKQVSAAVDSNGIGTMAAWQDGIKHANGPQDFSTRHVMVSLWDTIFWGASDSARDLSGKGYQTVLALPDYLYFDFPYTLNPRERGYYWGSQATDEYKVFSLAPENLPQNAEVMGDRDGNAFEVTGTGPAPRIEGIQGQAWGEVMRNDTFLEYMVYPRLLALAERAWHRADWELPYTAGVRYKRGDTHRVDTAALQRDWAGFATLVTQRELPKLDRAGIGYRKPTFTLTNP

SEQ ID NO: 2827 - protein, 800 aa, Burkholderia sp.
MTATAAAAPPASAPATPAELAALLANGLAVRVAVDNNHAASAGVPCADLGADWASCATGRLILQNRGHPPLTDGGWKLYLHSIRRLLRIDRPGFTLRHLTGDLYELTPQPGTVRLAQGERIELPFVAEYWLRRYSDVIPRPYVVVDGAAPAVLRYDDTDDELRYVETLPADAQNNSPGNAPPAAAQPVANRALPSVKRQRTLSGALDLRGVELTLPELPSAQVAALRDRAGTLGLDGARVPVWGAVAPRRLPADIAVPGGYRLAIGPRGAFIEGYDRAGLYYGVQTLFSLVPAGGATVPAMLIEDAPRFTHRGMHVDLARNFKPPATLRRLIDQMSAYKLNRLHLHLSDDEGWRIEIPGLPELTDVGARRCHDPGETRCLLPQLGSGPDNRSGGGYLTRDDYVALLRYAAERFVEVIPEIDMPAHSRAAVVSMEARYRRLHAAGREQEANAYRLLDPQDTSNLLTVQFYDRRSDLNPCMPGALNFASKVIREIASMHADAQAPLRIWHFGGDEAKNILLGAGFQPLDGADPGKGRVDLAAQDKPWARSPACTALLRRGEIKSIDELPTRFAKQVSAVVNANGIGTMAAWQDGIKHASGPQDFSTRSVMVSLWDTIFWGASDSARDLSAKGYRTVLALPDYLYFDFPYTRNPRERGYYWGSQATDEYKVFSLAPENLPQNAEVFGDRDGNPFEVTSAGAAPSIEGIQGQAWGEVMRNGPLLEYMVYPRLLALAERAWHKADWELPYAAGVRYRLGDTHHVDTAALERDWAGFATLLKQRELPKLERAGIGYRKPTFTLTGE

SEQ ID NO: 2828 - protein, 798 aa, Burkholderia sp.
RDSRRRSPASAPATPAELAALLANGLAVRVAVDNNHAASAGVPCADLGADWASCATGRLILQNRGHPPLTDGGWKLYLHSIRRLLRIDRPGFTLRHLTGDLYELTPQPGTVRLAQGERIELPFVAEYWLRRYSDVIPRPYVVVDGAAPAVLRYDDTDDELRYVETLPADAQNNSPGNAPPAAAQPVANRALPSVKRQRTLSGALDLRGVELTLPELPSAQVAALRDRAGTLGLDGARVPVWGAVAPRRLPADIAVPGGYRLAIGPRGAFIEGYDRAGLYYGVQTLFSLVPAGGATVPAMLIEDAPRFTHRGMHVDLARNFKPPATLRRLIDQMSAYKLNRLHLHLSDDEGWRIEIPGLPELTDVGARRCHDPGETRCLLPQLGSGPDNRSGGGYLTRDDYVALLRYAAERFVEVIPEIDMPAHSRAAVVSMEARYRRLHAAGREQEANAYRLLDPQDTSNLLTVQFYDRRSDLNPCMPGALNFASKVIREIASMHADAQAPLRIWHFGGDEAKNILLGAGFQPLDGADPGKGRVDLAAQDKPWARSPACTALLRRGEIKSIDELPTRFAKQVSAVVNANGIGTMAAWQDGIKHASGPQDFSTRSVMVSLWDTIFWGASDSARDLSAKGYRTVLALPDYLYFDFPYTRNPRERGYYWGSQATDEYKVFSLAPENLPQNAEVFGDRDGNPFEVTSAGAAPSIEGIQGQAWGEVMRNGPLLEYMVYPRLLALAERAWHKADWELPYAAGVRYRLGDTHHVDTAALERDWAGFATLLKQRELPKLERAGIGYRKPTFTLTGE

SEQ ID NO: 2829 - protein, 757 aa, Burkholderia sp.
MPCADLGADGAACATGRLILQNRGHQAIADGGWKLYLHSIRRLLRIDRPGFALRRLTGDLYELTPQPGSVRLAPGERIELPFVAEYWLLRYSDVIPRPYVVVEGAPPAVLRYDDTDDELRYVESLPADAQNNSTGNAPPVAARPDPSRALPSVKREQPLPGTLELRGVELALPDLPDAQVAALRERATTLGLDGARVSVRGAVAPRRLPADIATPGGYRLAIGPRGVLIEGYDRAGLYYGVQTLYSLAPAGGGPIPAMLVEDAPRFTHRGMHVDLARNFKHPATLRRLIDQMSAYKLNRLHLHLSDDEGWRIEIPGLPELTGIGSRRCHDPSETRCLLPQLGSGPDNRSGGGYLTRDDYVALVRYAAAHFVEIVPEIDMPAHARAAVVTMEARYRRLHAAGREQEANAYRLLDPQDTSNLTTVQFYDRRSDLNPCVPGALNFASKVIREIAAMHADAQAPLHIWHYGGDEAKNIFLGAGFQPLNGTDPNKGRIDLAAQDKPWARSPACTALLQRGEIKSIDELPTRFAQQVSAAVNANGIDTMAAWQDGIKHANGPQDFSTRHVMVSLWDTIFWGASDSARDLSGKGYLTVLALPDYLYFDFPYTLNPRERGYYWGSHATDEYKVFSLAPENLPQNAEVMGDRDGNPFEVTGTGPAPRIEGMQGQAWGEVMRNDTFLEYMAYPRLLALAERAWHRADWELPYAAGVRFKRGDTHHVDAAALQRDWAGFATLLTQRELPKLDRAGVGYRKPTFTLTNP

SEQ ID NO: 2830 - protein, 250 aa, Burkholderia sp.
MSIQLFSKQAKHARFARMFALLPICAAALTAGMQEASAHGAIGTPIARQYQCRLEGGYWDPADGSGIAHTDCRAAYQNGGNSAYPFTQWNEFSANPIGQGDDLEKLQQAVPDGLLCAGGDKKKSGIDVPAVAWRKTRVTPVGGKIDVTWENTQSHTPSVMRIYLSKPGYNPQQPLRWADLDKIYDAPAPAPQPANGGGRLPGTVTSFYKLSVPLPAGRTGDAVLYSYWQRRDAGNEGFFNCSDITILPGR

SEQ ID NO: 2831 - protein, 250 aa, Burkholderia sp.
MSIQSFSKEAKHAKFARMFALLPICAAALTAGMQEAGAHGAIGTPIARQYQCRLEGGYWDPADGSGIPHTDCRAAYQNGGNSAYPFTQWNEFSANPIGQGDDLEKLQQAVPDGLLCAGGDKKKSGIDVPAVAWRKTRVTPVGGKIDVTWENTQSHTPSVMRIYLSKPGYNPQQPLRWADLDKIYDAPAPAPQPANGGGHLPGTVTSFYKLSVPLPAGRTGDAVLYSYWQRRDAGNEGFFNCSDITILPGR

SEQ ID NO: 2832 - protein, 139 aa, Burkholderia sp.
MQQQHVSKFLLAAALALGLAGGAYAQSGLPDVKQQGDVSYVSGGVGLDESNAFQRAEHQWPLSIRFTGAGGEYLSGVHVSIMGHDGEVLKADTRGPYMLVRLAPGAYKVSANYNGKTEMRNVTVPAKGDAKLAFSWAAQ

SEQ ID NO: 2833 - protein, 142 aa, Burkholderia sp.
MQHQRISKYVLAVALAVGLVGGAYAQTDAGLPAVQQQGSVGYVSGGVGLDESTAFQRAEHHWPLSLRFTGQGGEFLAGVHVSIVGHGGDEVLKADTRGPYMLVRLAPGSYKVSASYNGKTETRSVSVPAKGGAKVAFSWNAQ

SEQ ID NO: 2834 - protein, 140 aa, Burkholderia sp.
MRQQTISKHLIAAALAFGLAGVANAQSGLPDVQHQGDVGFVSGGVGLDESTAFRRSESNWPLALRFTGAGGEYLSDVHVSVLDAHGGEVLKTDARGPYMLVRLKPGRYTVHASYNGNEQTRAVTVPAKGGAKAAFSWKAQ

SEQ ID NO: 2835 - protein, 140 aa, Burkholderia sp.
MRQQTISKHLIAAALAFGLAGVANAQSGLPDVQHQGDIGFVSGGVGLDESTAFRRSESSWPLALRFTGAGGEYLSDVHVSVLDAHGGEVLKTDARGPYMLVRLKPGRYTVHASYNGNEQTRAVTVPAKGGAKAAFSWKAQ

SEQ ID NO: 2836 - protein, 618 aa, Burkholderia sp.
MRTRLPRLASSALLALPLCLNLPAHADTVAANTSTPLAATPPMGFNNWARFQCTAQAPTDGSARANYSFQHFMLDQAEAMRATGLVASGYTLLWVDDCWMSRSGSGQIQGAARWGGSQQPGFDPDLGAYASAVHAKGMLAALYNTSGAKTCQGVAAGEQGHQLQDAQTYVAWGVDALKLDNCGAIDNATPQQLFKQMADALGQASAGSARKILFNESAPAGYGPTGSAKYATLDWVRPLGQMWRTGPDIRTTSMTASGQAASDPWDYYNANAYQEGVYQSYNETIALSRYVSPGNWNDPDQLLIGDNGLTPAEERSQMALWSAMAAPLILSTDVRKFAANPADPRWQQSLATLNNAEVVAVDQDRLGIGGYRVSRDDPSSSAGIEVVAKPLADHALAVVVLNKGAASASPTLSFANLGYRNGADGTPCTLAVRDLWAHSGSQLAAQVPLTIGAHDNAMLKLSGTCGGWAPTGEIETVGDWGATPLCIAAGSAAPGAALALANCDAGPKQRWSRKADRTVELAGTGLCLSSTAPGATLGGAAGQWATLASCNAQDTKQQFSYRRNGQLAAAADGTCLDIYRGVVDGTLGKPGTPLDLYACTANQVNQIWAAPHADVLND

SEQ ID NO: 2837 - protein, 568 aa, Burkholderia sp.
MQTARKALPLALSIALGLGMVHGVAAQSKTGNPQAENLRESLTRGVAKPAAGGEAAPSSTGAVSVTLANPAYRVKKTASTPEATARDFLATQAGQLGLDATALAGLELVSQRQDPDFTVVRLRQVVAGLPVYGSEIAVTIGKDGSVLYVASNAIGGVAPKASKTQAVDQQQALDRARSYLGIGELRNAEAQLVAFRDAAGTHTAWKVRGRPDGGPKGDWELLIDATSGEVLRAEDKAFYAVDGSGYVFRPDPLSSTKSSYGSTGYKDNNNADSTQLTAARVRVTLKDLKQSGASYSLSGPFASCVDFDAPRDNACPVQSSPAFEFTRGNLYFEAVNAYYHIDTFLRYVNQTLGIKALPYQYTGGVQFDPHGESGDDNSAYSSGSGQLTFGQGGVDDAEDADVVIHELGHGIHDWITNGGLSQSEGLSEGVGDYLAAGYSRDFNQWSPSDAQYNWVYNWDGHNEFWPGRVTNYNVGRTYAQIRSSEIHTAGQYWASCNLVARDAIGGQAMDKAFLKGLSMTNGSTNQKAAAQAVITAASALGYSSTQINAIANAYNKSCTYAVTVPQKS

SEQ ID NO: 2838 - protein, 570 aa, unknown
  environmental sample
MQTSRKALPLALGLALGFGIVGGTAADTKVSNPQATSLRESLTRGVAPPAARSDTAAGQFRADGVAVTLYNPAYRAKKAAATPAATARDFVASQAAQLGLDATALASLVVTSERSDAEFTVVRLQQQAAGLPVYGSEIAVTVAKDGRILYVASNTINGVVAKSGKAQAVDQQQALDRARAYLGVSGFTNQDAQLVAFVDKAGTHTAWKVRGRPNDGPKGDWELLIDSGSGEVLRAEDKAFYATDGTGFVFRPDPLSPTKSSYGSTGYKDSNDVDSSQLTAARVRVTLKDLAQSGARYSLSGPYAACVDFDAPRDNACPVQSTPAFEFTRGNLYFEAVNVYYHIDTFLRYVNQTLGIKALPYQYTGGVQYDPHGESGDDNSSYSSSSGRLTFGQGGVDDAEDADVVIHELGHGIHDWVTNGGLSQQEGLSEGTGDYLAAAYSRDFNQWSPSDAQYHWVYNWDGHNEFWGGRVTNWNVGRTYAQARGAEIHTAGQYWASCNLVARDAIGAQAMDKAFLKGLSMTNGSTNQKAAAQAVLTAASALGYSSAQLTAIGNAYNQSCTYGVTVPKKS

SEQ ID NO: 2839 - protein, 570 aa, Burkholderia sp.
MQTSRKALPLALSLALGFGIVGGTLADTKVSNPQAASLRESLTRGVAPPAAKADTAAGQFRADGVAVTLYNPAWRVKKAAATPAATARDFVASQAAQLGLDAAALASLVVTSERNDADFTVVRLQQQAAGLPVYGSDIAVTVAKDGRILYVASNTISGVVATTRKSQAVDQQQALDRARAYLGVSGFTHLDAQLVAFVDQAGTHTAWKVRGRPQDGPKGDWELLIDSGSGEVLRAEDKAFYATDGTGFVFRPDPLSPTKSSYGSTGYKDSSDADSTQLTAARVRVTLKELAQSGTRYTLTGPYAACIDFDAPLDKACPSQSTPAFEFTRGNLYFEAVNAYYHIDTFLRYVNQTLGIKALPYQYTGGVQYDPHGESGDDNSSYSSSSGRLTFGQGGVDDAEDADVVIHELGHGIHDWVTNGGLSQQEGLSEGTGDYLAAAYSRDFNQWSPSDAQYQWVYNWDGHNEFWGGRVTNWNVGRTYAQARGAEIHTAGQYWASCNLVARDAIGAQAMDKAFLKGLSMTNSSTNQKAAAQAVLTAAAALGYSSTQLTAIGNAYNKSCTYGVTVPQKS

SEQ ID NO: 2840 - protein, 570 aa, Burkholderia sp.
MQTSRKALPIALGLALGFGIVGGSAADTKVSNPQVTSLRESLTRGVAPPAAKADTAAGQFRADGVAVTLYNPAYRAKKAAATPAAAARDFVASQAAQLGLDQAALASLAVTSERSDADFTVVRLQQQAAGLPVYGSDIAVTVAKDGRILYVASNTINGAVATSRKSQAVDQQQAYDRARAYLGVSGFTNLDAQLVAFVDKAGTHTAWKVRGRPQDGPKGDWELLIDAGSGEVLRAEDKAFYATDGTGFVFRPDPLSSTKSSYGSTGYKDNNDADSPQLTAARVRVTLKDLAQSGGSYTLTGPYAACIDFDAPLDKACPAQTTPTFEFTRGNLYFEAVNAYYHIDTFLRYVNQTLGIKAMPYQYKGGVQYDPHGESGDDNSSYSSSSGRLTFGQGGVDDAEDADVVIHELGHGIHDWVTNGGLSQQEGLSEGTGDYLAAAYSRDFNQWSPSDAQYHWVYNWDGHNEYWGGRVTNWNVGRTYAQARGAEIHTAGQYWASCNLVARDAIGAQAMDKAFLKGLSMTNSSTNQKAAAQAVLTAASALGYSSAQLTAIGNAYNQSCTYGVTVPKKS

SEQ ID NO: 2841 - protein, 570 aa, Burkholderia sp.
MQTSRKALPLALSIALGFGVATSAAADHKNGDPQASSLRESLTRGVAPPAAKSDAPSGQFRADGVAVTLYNPPYQAKKAAATPAATARDFVASQAARLGLDAAALASLVVTSERKDPDFTVVRFQQQAAGLPVYGSDIAVTVGKDGRILYVASNTISGVAPKSAKAQAVDQQQALDRARAYLGVNGFVNVDAQLVVFVDAAGTHTAWKVRGKPQNGPKGDWELLIDAGSGEVLRAEDKAFYATDGTGFVFRPDPLSPTKSSYGSAGYKDGNDADSTQLTASRVRVTLKELAQSGSTYKLTGPYASCVDYDAPLDKACPVQATPNFEFTRGNLYFEAVNAYYHIDTFLRYVNQTLGVKALPYQYSGGVQYDPHGESGADNSSYSSGSGKLTFGQGGVDDAEDADVVIHELGHGIHDWITNGGLSQQEGLSEGTGDYLAAAYSRDFNQWSPSDAQYNWVFNWDGHNEFWGGRVTNWNVGRTYAQARGAEIHTAGQYWASCNLVARDAIGGAAMDKAFLKGLSMTNGSTNQKAAAQAVINAAATLGYSAAQIAAIGNAYNKSCTYAVTVPAKS

SEQ ID NO: 2842 - protein, 567 aa, Burkholderia sp.
MQTSRKALPLALSLAIGLGAALPAWADSKAPNPQEESRRASLTRGVVPPSEKADKTGQFRPGTVAVTLASPAFHAKKADAAAMAREFIAARATQLGLDKAALANLVVASERADATFTVVRFQQRAAGLPVYDSDIAITVAPDGRVLYVASKAVNGVAAVSSKTQAVDEQQALDRARAYLGVSGFASVQSQLVAFVDGTGTHTAWKVRGRPQDSLRGDWELIIDANSGEVLRAEDKASYATDGTGLVFRPDPLSPTKSSYGSTGFKDNNDADSPQLSAARVRVTLKDLTQTSGGYKLAGPYASCVDFDAPFDKACPVQPSPTFDFTRSNLYFEAVNAYYHIDTFLRYVNLTLGIKALPYQYSGGVQYDPHGESGDDNSSYSSGSGRLSFGQGGVDDAEDADVVIHELGHGIHDWITNGGLSQVEGLSEGTGDYLAAAYSRDFNQWSPSDAQYHWVYNWDGHNEFWPGRVTNYNVGRTYAQVRNSEIHTAGQYWASCNMVARDAIGGAAMDKAFLKGLSMTNGSTNQKAAAQAVLTAAAALGYSSAQLNAIGNAYNKSCTYGVTVPQKL

SEQ ID NO: 2843 - protein, 567 aa, Burkholderia sp.
MQTSRKALPLALGLAIGLGAALPAWADSKAPSPQEESRRASLTRGVVAPAEQAGKTGQFRPGAVAVTLASPAFHAKKADAAAMAREYVTARAAQLGLDKAALANLVVASERADAAFTVVRFQQRAAGLPVYDSDIAVTVAPDGRVLYVASKAVSGVAAVSSKTQAVDEQQALDRARAYLGVGGFVNVQSQLVAFVDGAGTHTAWKVSGRPQDSLHGDWELIIDAGSGEVLRAQDKASYATDGSGLVFRPDPLSPTKSSYGSPGFKDNNDADSPQLSAARVRVTLKDLTQTSGGYKLSGPYASCIDFDAPLDKACPVQASTTFDFTRSNLYFEAVNAYYHIDTFLRYVNLTLGIKALPYQYAGGVQYDPHGQSGDDNSSYSPSSGRLSFGQGGVDDAEDADVVIHELGHGIHDWITNGGLSQVEGLSEGTGDYLAATYSRDFNQWSPSDAQYHWVFNWDGHNEFWAGRVTNYNVGRTYAQIRNAAIHTAGQYWASCNMVARDAIGGAAMDKAFLKGLSMTNGSKNQKAAAQAVLTAAAALGYSSAQLNAIGDAYNKSCTYGVTVPQKL

SEQ ID NO: 2844 - protein, 560 aa, Burkholderia sp.
MPFALSLAIGIGAALPAWADSKAPNPQEESRRASLTRGVVPPAEKAGKTGQFRPGAVAVTLASPAFHAKKADAATMAREFIAARAAQLGLDPSALANLVVAAERADADFTVVRFQQRAAGLPVYDSDIAVTVAPDGRVLYVASKAVSGVAAVSSKALAVDEQQALDRARAYLGISGLAGVQSQLVAFVDGSGTHTAWKVRGKPQDGLRGDWELIIDANSGEVLRAEDKASYATDGSGLVFRPDPLSPTKSSYGSTGFKDNNDADSPQLNAARVRVTLKDLTQTSGGYKLSGPYASCVDFDAPRDNACPVQSSTTFDFTRSNLYFEAVNAYYHIDTFLRYVNLTLGIKALPYQYSGGVQYDPHGESGADNSSYSSGSGQLSFGQGGVDDAEDADVVIHELGHGIHDWITNGGLSQVEGLSEGTGDYLAAAYSRDFNQWSPSDAQYHWVFNWDGHNEFWPGRVTNYNVGRTYSQVRNTEIHTAGQYWASCNMVARDAIGGAAMDKAFLKGLSMTNGSTNQKAAAQAVLTAAAALGYSSAQLNAIGDAYNKSCTYGVTVPQKL

SEQ ID NO: 2845 - protein, 259 aa, Burkholderia sp.
MRRTIFTETTTYRRAVSRAIGLAAGAALVGGCTMTPWTDNWQPSQQAQPSRQSQAGVLAGYYRVNPGDTLPGIAAGFGQRVQDLANWNHIASTDMLTPGQVLRVAPPPGTTAVTSPVPGGTSPSASALPGTPPAEAQPMLAWPAQGTVTSRFIPGRTRGITITSTGDKTVRAAAAGRVVYAGNGVAKYGPLVILKHESGLITAYGHNGRLLVNDGDAVSAGQPVAEMQTDADGRSSFDFEVRQDGKPVDPMTFLPRNGG

SEQ ID NO: 2846 - protein, 237 aa, Salinibacillus sp.
MTRSSLRVLSAALVAGLALSAAAAPALASEPDLRVVTWDRGADPAADAQVSTGESCAVEAQPLLPGQDPDTLPPAPEVCFGSLEEALEFVSGGDVASSRLADATPAQVEGLVSELNASASVAPRLAGTERATAAAASSLVLGVLWRDANYKGASKVLYGSGTNGCYTGSTYGFPNLANLLMNNVVTSATTYAGCWVTLYDSYNYAGAKKNCTPHCSTLGTFDNRASSVVYRPAGQLG

SEQ ID NO: 2847 - protein, 238 aa, Cellulosimicrobium sp.
MTRTSLRVLSAALVSGLLLTAVGSGSALASVPDLRAVTGVRDVVAPAGDVSVSTGESCAVEAQPLLPGQDPDTLPPAPETCFASLAEALEFVSGSDVAASRLAEATRADVEGLVTELNAAAAAPRTAGAERVAAAAASSLVLGVLWRDASYKGASKVLYGSGTNGCYTGSTYGFPNLANLLMNNVVSSATTYAGCWVTLYDSYSYGGTKKNCTPHCATLGSFDNKASSVVYRPAGTLG

SEQ ID NO: 2848 - protein, 238 aa, Cellulosimicrobium sp.
MTSTPLRALSAGLVAGLALVGAVAAPSLASPSGVRAAPEDDPAAVRLADQPVATGESCAVEAQPLLPGEDPAALLAAPEVCFGSLEEALEFVSGDEVAPSRLARATRADVDGLVGELNATTTAGPRAAAERATTAAAGSIVLGVLWRDPSYKGASKVLYGSGTNGCHTGSTYGFPNLANLLMNNVVSSASTYAGCWVTLYDSYSYAGTKKNCTPHCASLGSFDDRASSVVYRPAGRLG

SEQ ID NO: 2849 - protein, 238 aa, Multievos46 sp.
MTSTPLRALSAGLVAGLVLVGAVAGPALASPSGVRAAPGDDLAAVPLADQPVATGESCAVEARPLLPGEDPASLPAAPEVCFGSLEEALEFVSGDEVAPSRLARATRADVDGLVGELNATTTAGPRAAAERATTAAAGSIVLGVLWRDPSYKGASKVLYGSGTNGCHTGSTYGFPNLANHLINNVVSSASTYAGCWVTLYDSYSYAGTKKNCTPHCASLGSFDDRASSVVYRPAGTLG

SEQ ID NO: 2850 - protein, 366 aa, Collimonas sp.
MRLTRHSRWQGVKRYAAVTLPVLFLAACATQEPTTSGTQNAASTGKPILAPKPAAPAVTPQQAELKSLVALQDRLYDVAAPLLVNNAVLCRNNARNLLGFTAKTKFSYTAEFIDAATSLGLTDQLQVTGVLTGSGAAKVGLQRGDLLVAIQDKPVPTGADAERQTALMLGPLVNGRSNIKVTIARNGSNQTLNVPLTRACAFGIELGNTDNVISYADGRRVLISAGMMKFVRSDDELAYVIAKEMAHNTLTHPARQRLTATLSGVIDNLVRLRPDNAPLSGAAGVKPYPQQLDAAADKLALYMVARAGYKVDDASAFWQRLATQYPATVLNGYTAIHPATTYRIAAIEQAVSDIQAKQASGSTVLP

SEQ ID NO: 2851 - protein, 366 aa, Collimonas sp.
MEKIMRLTSGLRWQGLKRYTAITLPILLLAACANTETASPEAAKPTATVSPKPAAVVVPPQQAELKTLIGLQDRLYDVAAPLLVNNALLCRNNARNLLGFTAKTKYSFTAEFLAAASSLGFTDQLQITGVLAGSGAAKSGLQRGDLLVAIQDKPAPVGADAERQTAMMLGPLVNGRNNIKVTVARSGSNLTMNVPLTRACAFGIELGNTDNVISYADGRRVLVSAGMMKFTQNDDELALVIAKEMAHNSLTHASRQRNTATMTGVIDNLIRLRPDATPLSGAAGVKPFPQQLDASADRLALYMVARAGYKVDDAGAFWQRLATQYPATVLNGYTAIHPATDYRMKAIDQTVSDIQAKQATGTTIQP

SEQ ID NO: 2852 - protein, 365 aa, Collimonas sp.
MMEKLMRLTRNNGWRQARRCATLALPVLLLAACATQEPATTAPQVVPVPPKPVVLTPPPQQAELKALIGLQDRLYDVAAPLLVNNALLCRNNARNLLGFTAKTKYSFTSEFIEAASALGLSDQLQVTGVLAGSGAAKVGLQRGDLLVSIQDKPVPAGADAERQTALLLGPLVNGRNSIKVVIARNGANQTLNIPLTRACAFGIELGNTENVISYADGRRVLISSGMMKYTKNNDELALVIAKEMAHNTLTHPSRQRNTATMTGVIDNLIRLKPDTAALNGMAGVKPYPQQLDVAADKLSLYMVARAGYKVDDAAAFWQRLATSYPASVLNGYTAIHPGTESRLSAIQQAVSDIQAKQASGTAIQP

SEQ ID NO: 2853 - protein, 208 aa, Collimonas Sp.
MKRISSRLILMLALAAPLAAQAHGYIDAPKSRAFMCKTQENTACGAIQYEPQSVEGPKGFPAAGPADGTIAAGGLAQFSELNVQTPTRWKKVALKTGALDFSWYFTAGHMTQDWRYYITKQGWDPSQKLSRDAFDLQPFCIVKGGFAPPSNSHATHRCTIPANRSGYHVILSTWNIADTGNAFYQVVDAQIQGGAAVNPQKVMINPFK

SEQ ID NO: 2854 - protein, 335 aa, Collimonas sp.
MIKFLFSALTLACALSGQASFAACMDGKPMAGVNLSGAEFAAEKLPGKVFTDYVYPDLDEMRLFQSMGMNTFRLPFLWERVQPKLFGELDQAELQRIKDSVAAASSIGVCMILDVHNYGQYRGQPIGSPQVPRAALTDLWQRLLANFKDPANVAFGLMNEPAKLPTAEWAATAQETLNALRRKGSRHLILVPGGGWSGAHSWYAKDGVVSNADAFRFFRDPADNYMIEVHQYADANFSGTGNECVEPAGLSAIMANVALWATSTRRRLFLGEFGVPANQQCLAALTAMMDAIKGNSAWGGWTYWAAGQWLGTYPFSVQPDGNGERPQMTILKKGM

SEQ ID NO: 2855 - protein, 357 aa, Herbaspirillum sp.
MIKRLSITARKCPWQWSALASHVRRMLGLALLAAGFLSGHAAVAGCLDGKRLAGVNLSGPEFAAEKLPGTVFKDYGYPDPDDMRYFQSAGMNTFRLPFLWERIQPQLFGPLDEAEVQRIEQTVATARSLGACIILDVHNFGEYRGKPLDSPAVPRKAFFDLWSRLLARFKAPENTAFGLMNEPSKLPIAAWAGVAQETLDILRKNGSRHLILVAGGSWSGAHAWFAKEQGVSNADAFSQFHDPANNYLIEVHQYADADFSGTQKSCIDPGRLNAVMNAITTWAKATKQRLFLGEFGVAPTPPCLQALSAIVGGMQDRAAWGGWTYWTSSKWLGDYPFNLGPDSNGDKPQMAILKTGL

SEQ ID NO: 2856 - protein, 287 aa, Dickeya sp.
MSIKVDITASSDNHQTIATATGNDIAVISNEERGTFQLNDQQLKRAVEVYFGRKPNDAYLSSPTPWGDLYKTYNWQQVMRTLQPVSTRVISQNSTPVIVMEQDFVNNSSVPAVYNVKISQSVQNTVKSSWNTGGKLTVGQKVKYGISFLGTGGGGESSISYEQSWGIGGEQSTTITLGTESGLQVTLQPGQAVTAELVASRGSMKVQVDYQASLSGISAVNYNPTYKDHHFWGLPITQIMRSSNISNSIVSSEIIDIGFYADSKVILRDKNTGGVFRTFNLFDKHTD

SEQ ID NO: 2857 - protein, 111 aa, Janthinobacterium sp.
MKRILGLALLGAAAAAQAGDITLYTRAHFGGPALQLHGSEPDLDKLGFNDRASSVIVQNGTWEVCENKHYKGKCLILEKGEYAELKNFNDMMSSVREIEAKPASRDKPGHK

SEQ ID NO: 2858 - protein, 121 aa, Duganella sp.
MRDTATLGSTVHEANSRPCAAGRRAAQAGDITLYTRAHFGGPALQLHGSEPDLDKLGFNDRASSVIVQNGTWEVCENKHYKGKCLILEKGEYAELKNFNDMMSSVREIEARPASKDKPEHK

SEQ ID NO: 2859 - protein, 454 aa, Janthinobacterium sp.
MHCKPLILTALSVLAIAPAVAAGPDTSRHQAQIDQIVKEISPARIEGYINKLVGFRTRHTMSDTVSETEGIGAARRWIKSELERCGAAQGGRLQVAFDSHIAPVSARISRPTEIVNVVATLPGTQAASVDRMYVVSGHYDSRNTDVMDAKGDAPGANDDASGTAAVMEMACVMAKYKFDATLVFMTVAAEEQGLLGAAHWAELARQKNLNIAGMFTNDIIGSSRDEHGKIDNTQVRLFAEGLPVQKENSDTVRTLIQTGGENDSLSRQLARAVKEAGERYVPKFKVNVIQRRDRYLRGGDHMPFLERGYAALRFTEPAEDFNHQHQNIRTENGVLIGDLPQYDDFNYIAQVARVNAAALSSLSLAPAAPAKVQVRTAKLQNDTELVWQANAEPDLAGYRIVWRDTSAAEWQGSQFVGKATEFTVPLSKDNYYFGVQAIDTEGNASPASYPTPLR

SEQ ID NO: 2860 - protein, 454 aa, Oxalobacteraceae sp.
MHKNSLILSALTVLAAVPAVAATPDTTRHQAQIDQIVQQISPARIEGYINKLAGFRTRHTMSDTVSETEGIGAARRWIKSELERCGAAQGGRLQVAFDSHIAPVSARISRPTEIVNVVATLPGAQSASVDRMYVVSGHYDSRNTDIMDAKGDAPGANDDASGTAAVMEMACVMARYKFDATLVFMTVAAEEQGLLGAAHWAEQAKQKNLNIAGMFTNDIIGSSHDEHGKVDNTQVRLFAEGLPVQKENSDAVRSLIQTGGENDSLSRQLARAVKEAGERYVPKFKVSVIQRRDRYLRGGDHMPFLERGYAALRFTEPAEDFKHQHQNIRTEKGVLIGDLPQYDDFNYIAQVARVNAAALSSLSLAPAAPARVQVRTAKLQNDTELLWQANAEPDLAGYRIVWRDTTSAEWQGSQFVGKATEFTVPLSKDNYYFGVQAIDNDGNASPASYPTPLR

SEQ ID NO: 2861 - protein, 451 aa, Janthinobacterium sp.
MGRILTAMTAAMLSAGAAAAPGAEPAQQQIRQVVADISPQRIEAHVRKLVGFQTRHTMSYTVSDTRGIGAARRWIKAELERCGAQAGGRLQVAFDSHIAPVSKRIARPTDIVNVVATLPGTQPQSAGRIYVVSGHYDSRATDVMDAQGDAPGANDDASGTAAVIETACAMARYQFDATIVFMAVAAEEQGLLGSGHWAQQAKLKNLNIAGMLNNDIIGSSRAEDGTVDGGQVRLFAEGIPAVKEMSDGVRALVATGGENDSISRQLARHVKQVGERYVPGFTVNVIQRADRYLRGGDHMPFLAQGYAALRFTEPHEDFAHQHQDVRVENGVQYGDLPQFVDYDYVAKVARVNAAALASLALAPAAPAGVQVRTAQLENATSLVWQPNTEPDLAGYRIVWRATTADQWQGAQDVGNVTEARVKLSKDNYFFGVQAIDRDGNVSVATYPMPLR

SEQ ID NO: 2862 - protein, 454 aa, Janthinobacterium sp.
MAGIVTAMTAMTAAMLSASVAAAPGAEPAQQQIRQVVADISPQRIEAHVRKLVSFGTRHTMSDTVSDTRGIGAARRWIKAELERCGAQAGGRLQVAFDSHVAPVSKRIARPTEIVNVVATLPGSQPQSAGRIYVVSGHYDSRATDVMDAQGDAPGANDDASGTAAVIEMACAMARHQFDATLVFMAVAAEEQGLLGSGHWAQQAKLNKLNIAGMLNNDIIGSSRAEDGTVDGGQVRLFAEGIPAVKEMSDGVRALVATGGENDSLSRQLARHVKQVGERYVPGFKVNVIQRADRYLRGGDHMPFLAQGYAALRFTEPHEDFAHQHQDVRVENGVQYGDLPQFVDDEYVAKVARVNAAALASLALAPAAPAGVQVRTAQLENATALVWQPNTEPDLAGYRIVWRATTADQWQGAQDVGKVTEAKVKLSKDSYFFGVQAIDNDGNVSVATYPMPLR

SEQ ID NO: 2863 - protein, 454 aa, Janthinobacterium sp.
MAGIVTAMTAMTAAMLSASVAAAPGADPAQQQIRQVVADISPQRIEAHVRKLVSFGTRHTMSDTVSDTRGIGAARRWIKAELERCGAQAGGRLQVAFDSHVAPVSKRIARPTEIVNVVATLPGSQPQSAGRIYVVSGHYDTRATDVMDAQGDAPGANDDASGTAAVIEMACAMARHQFDATLVFMAVAAEEQGLLGSGHWAQQAKLNKLNIAGMLNNDIIGSSRAEDGTVDGGQVRLFAEGIPAVKEMSDGVRALVATGGENDSLSRQLARHVKQVGERYVPGFKVNVIQRADRYLRGGDHMPFLAQGYAALRFTEPHEDFAHQHQDVRVENGVQYGDLPQFVDYDYLAKVARVNAAALASLALAPAAPAGVQVRTAQLENATTLLWQPNTEPDLAGYRIVWRATTADQWQGAQDVGNVTEAKVKLSKDSYFFGVQAIDRDGNVSVATYPMPLR

SEQ ID NO: 2864 - protein, 458 aa, Massilia sp.
MPRSRISSRLLAALLAAASASTAAAPAAAPDISREQAQIRKIVAEISPKRIEAYVRKLVGFGTRHTMSDTGSETRGIGAARRWIKAELERCGAGTPLQVAFDSHVAPVSPRISRPTEIVNVVATLPGAQDAAKDRYYVVSGHYDSRATDVMDATSEAPGANDDASGTAAVMELACVMAKYKFDASLVFMAVAAEEQGLIGARHWAVQAREKNLNVAGMFTNDIIGSSRADDGKIDNKQVRLFAQSIPATKEMSEAVRQLVATGGENDSISRQLARHTKEQGERYVKGFKVSVIQRHDRYLRGGDHMPFLEQGYAALRFTEPNEDFAHQHQDLRTENGKVYGDLIEFVDFDYIARVARVNGAALASLALAPAAPREVRLRTDKLTNDSTLVWQPNPEPDVAGYRIVWRDTTAANWQGAKWVGNVTEATVDLSKDNVFFGVQAVDRDGNVGVATYPSPQR

SEQ ID NO: 2865 - protein, 408 aa, Duganella sp.
MTTTTAPKLALAAAILLAYSAPSLAAATCDRYASYPVKGGTYTVITNFWNDKASGSQCVNVNQESGEWSVSSAPSSPDSTPAAYPAIYKGCHWASCTKDSGLPLQAKAITYAPTRWRVTPGAGGDWDIAYDIWFSSGREAPPSGQPDGAEIMIWINHSGSVQPAGTKTANVNINGMNWDVWTAWNNPSGWPRWNIVSYVATSPVNAVNFDLVPFFRDSVGRKAVDNNWYLLDVEAGTELWRNGAGFASGDFDVQFHTDPVKGIDPNKWYSVVNKNSGSCVDDADFSTSNGAVVHQWACDSRGAANQQWKFTPTDSGNYRVSTQQAPGLAWDVAGWGTANGSLVQLWTYGGGSNQQWQAVDLGDGYYKFVGRGSGKCLDVPAASTSNGVQLQVYDCNGTPAQSFKLIAQ

SEQ ID NO: 2866 - protein, 408 aa, Janthinobacterium sp.
MTTTTAPKLALAAAILLAYSAPSLAASTCDRYASYPVKGGTYTVITNFWNDKASGAQCVNVNQDNGEWSVSSAPSSPDSTPAAYPAIYKGCHWASCTKDSGLPLQAKAITYAPTRWRVTPGAGGDWDIAYDIWFSSGREAPPSGQPDGAEIMIWINHSGSVQPAGAKTANVNINGMNWDVWTAWNNPSGWPRWNIVSYVATSPVNAVNFDLVPFFRDSVGRKAVDNNWYLLDVEAGTELWRNGAGFVSGDFDVQFHTDPVVGIDPNKWYSVVNKNSGSCVDDADFSTSNGAVVHQWACDSRGAANQQWKFTPTDSGNYRVSTQQAPGLAWDVAGWGTANGSPVQLWTYGGGSNQQWQAVDQGDGYYKFVGRGSGKCLDVPAASTSNGVQLQIYDCNGTSAQSFKLIAQ

SEQ ID NO: 2867 - protein, 408 aa, Oxalobacteraceae sp.
MPYTTFSKLTLAAAITLAYSAPGMAASSCERYASYPVLGETYTVITNFWNDKAGGSQCINVNPDTGEWSLSSAPSSPDSTPASYPAIYKGCHWGSCTKDSGLPLQAKALTYAPTRWRIAPGAAGNWDVAYDIWFSSGPTAPASGQPDGAEIMIWINHNGPAQPAGSKTGNVNINGMNWDVWVDWKNPGGWPGWNIISYVATSPVNEVNFDLAPFFRDSLGRNVVDNNWYLLDVEAGTEIWRNGAGFASSAFDVQFHTDPVKGIDPGKWYSVVNKNSGSCIDDAGYSNSNGAAVQQWACDSRGAANQQWQFTPTDSGNYRVSTQQAPALAWDVAGWGTANGSPVQLWTYGGGSNQQWQAVDLGDGYYKFVGRASGKCLDVPAASTSNGVPLQLWDCNGTPAQSFKLIAQ

SEQ ID NO: 2868 - protein, 270 aa, Janthinobacterium sp.
MNKPLNIAMAIATLTLASQAMAQITFYEHDGWRGRTFTANQQVRDFTRNGFNDRASSVVVDRGQWEVCDDANFRGNCMVLRHGSYESLAGMGLNDRISSVRPVGKRNSYANEAPAPLPQPTYEYRRRPRERLVEVPVTSVRAVVGTPEQRCWVERQQVAEPARNGANVGGVIAGALIGGILGHQVGGGTGRDVATAGGAVAGAAIGNNMANNSGQQSYARDVRRCENVSNPKPEYWDVTYNYRGQEHRVQMSTPPGQSIAVNSNTGEPRM

SEQ ID NO: 2869 - protein, 272 aa, Oxalobacteraceae sp.
MNMNQPLQLAIALAALTLTSQAMAQITFYEHDGWRGRAFTASRPVNDFSRTGFNDRASSVVVERGQWEVCDDASFRGKCMVLRRGSYDSLGGMGMNDRISSVRPVSRRNRYAHEAPAPLPQPTYEYRRRPSERVVEVPISSVHAVVGTPEQRCWVERQQVTEPARSGNNVGGVIAGALIGGILGHQVGGGTGRDVATAGGAVAGAAIGNNMANRSNSQSYARDVRRCENVSNPTPQYWDVTYNYRGQQHRVQMSTAPGQTISVNAKTGEPRM

SEQ ID NO: 2870 - protein, 128 aa, Streptomyces sp.
MRNSLSALLVAVAAATATVVPTSTAHAADGYDRCADGYYCMFSGLDGTGDMIMLRGSAPDLAALGMNDRAKSDWNRTSSTIHLWSDTNYSGCTAVTSSGPTGKGNYFPAYQNFFSSVQFDGPDGPSCG

SEQ ID NO: 2871 - protein, 133 aa, Streptomyces sp.
MRETLRALLVPVVAGAAMTLPVTTAHAASGYDRCPAGYYCMFSGLDGTGDMIRLTGSTPDLAALGMNDRAKSDWNRTASTVHLWSDANYTGCTAVTSSGPTGRGNFFPDYQNFFSSVQFDGPGGPSCGTASGD

SEQ ID NO: 2872 - protein, 169 aa, Streptomyces sp.
MARAPLFQWSRLAHSWARMTARMTEGIAMRRVIATRRKLSVLVAVLAAAGASVVPVSTAHAADGYDRCPDGYYCMFSGLDGTGDMIALRGNTPDLAALGMNDRAKSDWNRTPSTIYLWSDLHYSGCTAVTSSGPTGKGNFFPTYQDFFSSVQFDGPGGPSCGTPPGEGG

SEQ ID NO: 2873 - protein, 602 aa, Pseudomonas sp.
MAIFDYKGQDGRVLISDAWNLATYTSGVATVGALYNLPGAVLGEGNTFVLPKGWREISASDLGIDGSHLDLTGSFKGENVSGSQAKVFGQYDESGKLVKMGFSIAGTNSPMDLLGYPAMIDNSYIHGYDYLLDSIKNYATSHNLTGKDVLVTGYSQGGSVTNSMYLGKDTLADGFFKDSDYFGMASPKASNSDGIFNFGFENDIVHRLIGEQTDLSGAILAALKGSDANYTSTTDNIVLFDTVYALPTWPNGPFSVVNPNGWVAHLEGIFINPIQRIGQSTFYDYIERDSTIIISNLDPVSRSFTWVSDKYSATSNHFGTPAFLLGTDSADKLQDGRNDDFLDGFAGNDSFKVSTGTDIVAGGVGDDKVFLQGTVSSYEAVRLSDGSLFLNDTGGRYGLKELHDVEHVEFEGLLGQALTPAYTVTSSKLNFEGLFGSDKSYAKATEGTQLADLLKGTAGRDLIFGQGGDDLIEGGAGHDLLHGGSGNDTLLGGSGNDALYGGAQNDILVGGLGNDTLSGGVGSDLFVFDLGGFGHDLISDFNVHQNGFDQLVFSKSLFASAAAVISATSQQGSDSLIVAGDSSITLVGFNPAQLSADMISLV

SEQ ID NO: 2874 - protein, 602 aa, Pseudomonas sp.
MAIFDYKGQDGRVLISDAWNLATYTSGVATVGALYNLPGAVLGEGNTFALPKGWREISASDLGIDGSHLDLTGSFKGENVSGSQAKVFGQYDESGKLVKMGFSIAGTNSPMDLLGYPAMIDNSYIRGYDYLLDSIKNYATSHNLTGKDVLVTGYSQGGSVTNSMYLGKDTLADGFFKDSDYFGMASPKASNNDGIFNFGFENDIVHRLIGEQTDLSGAILAALKGSDANYTSTTDNIVLFDTVYALPTWPNGPFSVINPSGWVAHLEGIFINPIQRIGQSTFYDYIERDSTIIISNLDPISRGFTWVHDKASATSNHFGTPAFLLGTDSNDKLQDGRNDDFLDGFAGNDSFRVSTGTDIVAGGVGDDKVFLQGTVSSYEAVRLSDGSLFLNDTSGRYGLKELHDVEHVEFEGLLGQTLTPAFTVTSGKLDYEGLFGSNKSYAKATEGTQLADLLKGTSSRDLIFGQGGDDLIEGGAGNDLLHGGSGNDTLLGGNGNDALYGGAHNDILVGGLGNDTLSGGVGSDLFVFDQGGFGHDLISDFNVHQNGFDQLVFSKSLFASAAAVISATSQQGSDSLIVAGDSSITLVGFNPAQLSADMISLV

SEQ ID NO: 2875 - protein, 602 aa, Pseudomonas sp.
MAIFDYKGQDGRVLISDAWNLATYTSGVATVGALYNLPGAVLGEGNTFALPKGWREISASDLNIDSSHLDLTGSFKGENVSGSQAKVFGQYDESGKLVKMGFSIAGTNSPMDLLGYPAMIDNSYIRGYDYLLDSIKNYATSHNLTGKDVLVTGYSQGGSVTNSMYLGKDTLADGFFKDSDYFGMASPKASNNDGIFNFGFENDIVHRLIGEQTDLSGAILAALKGSDANYTSTTDNIVLFDTVYALPTWPNGPFSVINPSGWVAHLEGIFINPIQRIGQSTFYDYIERDSTIIISNLDPISRGFTWVHDKASATSNHFGTPAFLLGTDSNDKLQDGRNDDFLDGFAGNDSFRVSTGTDIVAGGVGDDKVFLQGTVSSYEAVRLSDGSLFLNDTSGRYGLKELHDVEHVEFEGLLGQTLTPAFTVTSGKLDYEGLFGSNKSYAKATEGTQLADLLKGTSSRDLIFGQGGDDLIEGGAGNDLLHGGSGNDTLLGGNGNDALYGGAHNDILVGGLGNDTLSGGVGSDLFVFDQGGFGHDLISDFNVHQNGFDQLVFSKSLFASAAAVISATSQQGSDSLIVAGDSSITLVGFNPAQLSADMISLV

SEQ ID NO: 2876 - protein, 577 aa, unknown
  environmental sample
SGVATVGALYHLPGAVLGEGNTFVLPKGWREISASDLGIDGSHLDLTGSFKGENVSGSQAKVFGQYDESGKLVKMGFSIAGTNSPMDLLGYPAMIDNSYIHGYDYLLDSIKNYASSHNLTGKDVLVTGYSQGGSVTNSMYQGRETLADGFFKDSDYFGMASPKASNSDGIFNFGFENDIVHRLIGEQTDLSGAILAALKGSDASYTSTTDNIVLFDTVYALPTWPNGPFSVINPNGWVAHLEGVFINPIQRIGQSTFYDYIERDSTIIISNLDPVSRSFTWVSDKYSATSNHFGTPAFLLGTDSADKLQDGRNDDFLDGFAGNDSFKVSTGTDIVAGGVGDDKVFLQGTVTSYEAVRLSDGSLFLNDTNGRYGLKELHDVEHVEFEGLLGQALTPAFTVTGSKLDFEGLFGSDKSYAKATEGTQLADLLKGTASRDLIFGQGGDDLIEGGAGHDLLHGGSGNDTLLGGNGNDALYGGAHNDILVGGLGNDTLSGGVGSDLFVFDVGGFGHDVISDFNVHQNGFDQLVFSKSLFASTAAVLSATSQQGSDSLIVAGDSSITLVGLNPAQLSADMISLV

SEQ ID NO: 2877 - protein, 619 aa, Pseudomonas sp.
MAIFDYKGQDGRTLISDAWNLATYTSGVATVGVLYNLPGMVLGEGNTFALPKGWREISASDLGIDSSHTDLTGSFTGENVFGSQAKVFGQYNDSGQLIKMGFSIAGTNSPIDLLGWPAMIDNSYIRGYDYLLDAIKDYATGHNLTGKDVLVTGYSQGGSVTNSMYLGKDTLADGFFKDSDYFGMESPKASNSDGIFNFGFENDIVHRLIGEETDLGSAIIDALQGSDASYTSSTDNIVLFDTVYALPTWPNGPFSIVNPSGWVPHLEGIFINPIQRIGQSTFYDYIERDSTIIISNLDPISRSFTWVSDKQTATSNHFGTPAFLLGTDSADKLQDGSNDDFLDGFAGDDSFRVSTGTDIVAGGTGDDKVFLKGAAANYEAVRLSDGSLFLNDTTGTYGLKELHGVEHVEFETSLANALGELPIIGGIFGSLGQILTPAYTVTSGKLDFEGLFGADKSYAKATEGTQLADTLKGTAARDLIFGQGGNDRLDGGAGNDLLHGGDGNDTLLGGSGNDALYGGAGNDILVGGLGNDTLSGGVGSDLFVFDQSGFGHDRISDFNVHQNGLDQLVFSKSLFASTDAVLNATSQQGSDSLIVAGNSSITLVGFSPTQLSAEMISLV

SEQ ID NO: 2878 - protein, 619 aa, unknown
  environmental sample
MAIFDYKGQDARVLISDAWTLATYTSGVATVGALYNIPGLVLGEGNTFALPKGWREIGASELQVDSSHIDITGSFTGDGVFGSQARVFGQYDDSGQLVKMGFSIAGTNSPIDLLGWPAMIDNSYINGYDYLLNSIKDYATGHNLSGKDVLVTGYSQGGSVTNSMYIGKDTLADGFFKDSDYFGMESPKSSNSDGIFNFGFENDVVHRLTGQETNVGSAIIDALQGSDASYTSTTDNIVLFDTIYALPTWPNGPFSIANLSGWAAHLEGIFINPIQRIAQSTFYDYIERDSTIIISNLDAISRSFTWVSDKQTATSNHYGTPAFLLGTDSSDKLQDGRSDDFLDGFKGDDSFRVSTGTDIVAGGEGNDKVFLKGTASSYEAVKLSDGTLFLNDSSGQYGLKELHGVEHVEFETGLANSLGQVPVFGGLFGGIGEVLTPAYTVTSGKLDFEGLFGADKAYARSIEGSQLADTLKGTAARDLIFGQNGNDRLDGGAGNDLLHGGDGNDTLLGGTGNDALYGASGNDVLIGGLGNDQLSGGVGSDLFVFDQRGFGHDVISDFNIHQNGQDLLVFAKSLFASADAVLGATTQHGSDSVILAGDSSVTLVGFNAAQLSAEMISVV

SEQ ID NO: 2879 - protein, 619 aa, Pseudomonas sp.
MAIFDYKGQDARVLISDAWNLATYTSGVATVGALYNLPGAVLGEGNTFALPKGWREIGANELSVDSSHTDITGSFTGDGVFGSQARVFGQYDDSGQLLKMGFSIAGTNSLTDLLGWPAMIDNSYINGYEYLLNSIKDYAIGHNLSGKDVLVTGYSQGGSVTNSMYIGKDTLADGFFKDSDYFGMESPKSSNSDGIYNFGFENDVVHRLTGQETNVGSAIIDALQGSDASYTSTTDNIVLFDTIYALPTWPNGPFSIANLSGWAAHLEGIFINPIQRIAQSTFYDYIERDSTIVISNLDAISRSFTWVSDKQTATSNHYGTPAFLLGTDSADKLQDGRSDDFLDGFSGNDSFRVSTGTDIVAGGAGDDKVFLKGTASAYEAVKLSDGTLFLNDSSGQYGLKELHGVEHVEFETGLANTLGQLPVIGGIFSGIGQTLTPSYTVTNGKLDFDGLFGADKAYARSIEGSQLADTLKGTAARDLIFGQNGNDRLDGGAGNDLLHGGDGNDTLLGGMGNDSLYGASGNDVLIGGQGNDQLSGGVGSDLFVFDQRGFGHDVISDFNIHQNGHDLLVFAKSLFASADAVIGSTTQNGSDSVILAGDSSVTLVGFNAAQLSAEMISVV

SEQ ID NO: 2880 - protein, 619 aa, Pseudomonas sp.
MAIFDYKGQDARTLISDAWTLATYTSGTATVGALYNIPGAILGEGNSFSLPKGWREINASELDVDNSRLDITGSFTGGGVFGAQARVFGQYDSSGQLTKMAFSIAGTNSPIDLIGWPAMIDNSYINGFDYLLDAIKDYAVAKNLSGKDVLVTGYSQGGAVTNGMFLTKDTLADGFFKDSDYFGMESPKVGNDSGIFNFGFENDVVHRLIGEETNLGSAAIDALTGSDINYTSTTDNIVLFDTIYALPTWPNGPFSIANLTGWAAHLEGIFINPIQTISQSTFYDHIEQDSTIIISNLDPISRSFTWVSDKATATSNHYGTPAFLLGTASGDKLQDGRSDDFLDGFAGDDSFRVSTGTDIVAGGAGSDKVFLKGAVANYEAVKLSDGTLFLNDTTGQYGLKELHSVEFVEFETALATATSQLPFVGGFLSSVGQVLTPAYAVTSDKLDYQGWFGSDKSYNKAIEGTAQADSLIGTSGRDLMFGQAGNDTLSGGAGNDLLHGGEGNDTLLGGTGNDQLYGGAGNDILVGGQGNDLLSGGVGSDVFVFDQAGFGQDRISDFNIHQNGLDVLVFSKSLFASVDAVLSAASQQDNDTVIQTIDGSVTLVGFSPANLTADMLSLA

SEQ ID NO: 2881 - protein, 354 aa, Erwinia sp.
MSTGSPVFKFSRIAAVSLVGFWLAGCSNDSTQAPISSVGGDSGISSPSSSGGMLAGRAPASTMGSAQNMGSAESNVQTQNGRIVYNRTYGNIPKGSYSGQTYTVKRGDTLFYIAWITGNDFRDLAQRNNVAEPYSLNVGQTLQVSNGSGSSITGGNAITVADATQGGVPTPPSSTQIKSSTVAQQPVITYSEDSGKSSGGKMLPSSGTTVATTTAPVTAPTVSSTTNSSTPVGSWRWPTDGKIIDNFSASEGGNKGVDIAGSRGQPVVSTASGRVVYAGNALRGYGNLIIIKHNDDYLSAYAHNDTMLVREQQEVKAGQKIATMGSTGTSSVRLHFEIRYKGKSVNPLRYLPQR

SEQ ID NO: 2882 - protein, 353 aa, Pantoea sp.
MSTGSPVFTLSRIAAVSLVSFWLAGCSSSDNTQAPISAVGSRSDAASANSGLVTRPAISTNASSGNIASNNGNVVTQNGRIVYNRSYGNIPKGSYSGQTYTVKRGDTLFYIAWITGNDFRDLAQRNNIPAPYELNVGQQLQVSNSSGGTLTGGNAITAADDSAGGVPATPGSAQIKGGTVAPPPVITYSGNSGKSNEGKMLPSSGTNTVATTTAPVTAPTVSSTTSSSTPVGSWLWPTNGKIIDNFSASEGGNKGVDIAGSRGQAVISTASGRVVYAGNALRGYGNLIIIKHNDDYLSAYAHNDTMLVREQQEVKAGQKIATMGSTGTSSVRLHFEIRYKGKSVNPLRYLPQR

SEQ ID NO: 2883 - protein, 369 aa, unknown
  environmental sample
MSTGSPVFKLRRIAAVSLVGFWLAGCSSSDNTQAPISSVGGNDSGMMSSNPAMSSASGASSGGSNGGFIPPARPPSTGGMVTPSAAPEQNVTTENGHIVYNRSYGNIPKGSYGGDSYTVKRGDTLFYIAWITGNDFRDLAQRNNIAAPYSLNVGQQLQVANGTGTPITGGNAVTAADATAGGVSTPPSGAQMTTATVAHQPVITYSEDSGTQSGGKMLPSSGKTAATTTVPVTAPTVSSTTDSTTPVGSWRWPTDGKIIDNFSASEGGNKGIDIAGSRGQSVVSTASGRVVYAGNALRGYGNLIIIKHNDDYLSAYAHNDTMLVREQQEVKAGQKIATMGSTGTSSVRLHFEIRYKGKSVNPLRYLPQR

SEQ ID NO: 2884 - protein, 366 aa, unknown
  environmental sample
MSTGSTIFQLRRLAALSLVGFWLAGCSSSDNTQAPISRVGDGGGMSSSQSGAASASGGVPAMPSQGGMLSGSAASASGNGGMVSANNNVETQNGRIVYNRSYQNIPKGSYSGETYTVKRGDTLFYIAWITGNDFRDLAQRNNVPAPYSLNVGQTLQIGNGSGQPITGGNAITVADATQGGVPTTPQIKSAAVAQQPVITYSDDSGSSSGSKLLPSKGANVATTTAPVVTAPPTVSSTTNSSTPVGSWRWPTDGKIIDNFSAAEGGNKGIDIAGTRGQSVVATASGRVVYAGNALRGYGNLIIIKHNDDYLSAYAHNDTMLVREQQEVKAGQKIATMGSTGTSSVRLHFEIRYKGKSVNPLRYLPQR

SEQ ID NO: 2885 - protein, 366 aa, unknown
  environmental sample
MSTGSTLFQLRRLAALSLVGFWLAGCSSSDNSQAPISRVGDNGGMNTNQSGADMSSGGVPATPAQGQMLSKNSASAPASGGMISTNSNVETQNGRIVYNRSYQNIPKGSYSGETYTVKRGDTLFYIAWITGNDFRDLAQRNNVPAPYGLNVGQTLQIGNGSGQPITGGNPITVADATQGGVPAAPQIKSPAVAQQPVITYSDDSGNSGGSKMLPSNGANVATTTAPVVTAPPTVSSTTNSSTPVGSWRWPTDGKIIDNFSAAEGGNKGIDIAGTRGQSVVATASGRVVYAGNALRGYGNLIIIKHNDDYLSAYAHNDTMLVREQQEVKAGQKIATMGSTGTSSVRLHFEIRYKGKSVNPLRYLPQR

SEQ ID NO: 2886 - protein, 366 aa, unknown
  environmental sample
MSTGSTLFQLRRLAALSLVGFWLAGCSSGDNSQAPISRVGDDGGMMNSQAGAGPVSGGVPAAPSQGQMLSRNSASVPSNGGMISTNSNVETQNGRIVYNRSYQNIPKGSYSGETYTVKRGDTLFYIAWITGNDFRDLAQRNNVAAPYSLNVGQTLQIGNGSGQPITGGNPITVADATQGGVPAAPQIKSPAVAQQPVITYSDDSGNSGGSKLLPSKGANVATTTAPVITAPPTVSSTTNSSTPVGSWRWPTDGKIIDNFSAAEGGNKGIDIAGTRGQSVVATASGRVVYAGNALRGYGNLIIIKHNDDYLSAYAHNDTMLVREQQEVKAGQKIATMGSTGTSSVRLHFEIRYKGKSVNPLRYLPQR

SEQ ID NO: 2887 - protein, 371 aa, Pantoea sp.
MSTGSTIFQLRRLAALSLVSFWLAGCSSGDNTQAPISNIGDSNSVNDNSNMAGSGTAPATGGVPSVPPQGGMLSRSTPLPQNNPGIISANNNNVQTENGRIVYNRSYQNIPKGSYSGQTYTVKRGDTLFYIAWITGNDFRDLAQRNNVQAPYSLNVGQTLQVDNGSGQPITGGNAITAADATQSGVVSAPQIKQAPVAQQPVITYSDDSGESSGSKLLPSKGANVATTTAPAVTAPPTVSSTTNSSTPVGSWRWPTEGKIIDNFSAAEGGNKGIDIAGSRGQPIVATASGRVVYAGNALRGYGNLIIIKHNDDYLSAYAHNDTMLVREQQEVKAGQKIATMGSTGTSSVRLHFEIRYKGKSVNPLRYLPQR

SEQ ID NO: 2888 - protein, 374 aa, Pantoea sp.
MSTGSTIFQLRRLAALSLVSFWLAGCSSGDNTQAPISNIGDGSSMNDNGNMASTGTAPVASGVPTTPSQGGMLSRNTPVPQNKPGIISTGNNTSNEVETQNGRIVYNRSYQNIPKGSYSGQTYTVKRGDTLFYIAWITGNDFRDLAQRNNVQPPYSLNVGQTLQVDNGSGQPITGGNAITAADASQSGIVTAPQIKQAPVAQQPVITYSDDSGNSNGSKLLPSKGANVATTTAPAVTAPPTVSSTTNSSTPVGSWRWPTEGKIIDNFSATEGGNKGIDIAGSRGQPVVATASGRVVYAGNALRGYGNLIIIKHNDDYLSAYAHNDTMLVREQQEVKAGQKIATMGSTGTSSVRLHFEIRFKGKSVNPLRYLPQR

SEQ ID NO: 2889 - protein, 380 aa, Pantoea sp.
MSTGSPTFQLRRIAALSLVTLWLAGCSSGDNTQAPISSVNDNSGMSQSGMLSGNSSGIPRQGGGMLSGGVPATPSRGGMLSGTSSSVPAQGGMISENNNVTTENGRIVYNRNYQNIPKGSYGGNTYTVRRGDTLFYIAWITGNDFRDLAQRNNISAPYSLNAGQVLQVENGGGQPITGGNAITTADARQQGVTPPPETTQIHTAPVAQQPVITYSEDSDDTGGSKLLPSRGANVATTTAPVVTAPPTASSTTDSSTPVGSWRWPTEGKIIDNFSASEGGNKGIDIAGSRGQPVVATASGRVVYAGNALRGYGNLIIIKHNDDYLSAYAHNDTMLVREQQEVKAGQKIATMGSTGTSSVRLHFEIRYKGKSVNPLRYLPQR

SEQ ID NO: 2890 - protein, 300 aa, Pantoea sp.
MISNTVPSAPSSGAMVSGNDNVQTQNGRIVYNRSYQNIPKGSYAGDTYTVKRGDTLFYIAWITGNDFRDLAQRNNVQAPYGLNVGQTLQVGNGSGQPITGGNAITAADATQGGVPTAPQIKPAPVAQQPVITYSDDSGNSSGSKMLPSKGTNVATTTAPPVVAAPPTVSSTTNSSTPVGSWRWPTDGKIIDNFSASEGGNKGIDIAGSRGQPVVATASGRVVYAGNALRGYGNLIIIKHNDDYLSAYAHNDTMLVREQQEVKAGQKIATMGSTGTSSVRLHFEIRYKGKSVNPLRYLPQR

SEQ ID NO: 2891 - protein, 551 aa, Erwinia sp.
MKFGLVLALLLTTFSSLAANLSDIKVSNGDDKATVTLSFNGQPVYGFFPLHNPDRVVLDIRQSGVIKGLPLTFSGENIVKRIRSSTPKDKQSIRLVFELTQASKTRAVTQREGNNYNVVFTIAGTRPAATASRRPAEVSSASSSAPSAPVENPFKGNPVTAVSSGNDVVRPGRTPVSANEAVIVAIDAGHGGQDPGAIGAGGLKEKNVTIAIARKLKALLNADPMFKGVMTRDGDYFISVMGRSDVARKQNANVLVSIHADAAPNRSASGASVWVLSNRRANSEMAGWLEQHEKQSELLGGAGDLLANSQADPYLSQAVLDLQFGHSQRVGYDVAVKVIAQLQRVGSLHKRRPEHASLGVLRSPDIPSLLVETGFISNPSEERLLGSSAYQQKIAESIYKGLRNYFLAHPLQSIPKEENRPLQSAATVNVEPNPAPDTTQYTGAIQRHVVKRGETASGIAARYGISMATLRSMNTLKKDVVWVGQRLKVPAGSQPAAVTKAKTPVRHKVVRGDSLTAIAAHYGVSPKAIQQANKMKSQNVMLGQTLTIPTS

SEQ ID NO: 2892 - protein, 556 aa, Erwinia sp.
MLRMKFGFLLVLILATFSSLAANLADIKVANGNNQATVTLSFNGQPVYGFFPLHNPNRVVLDIRQSGVVKGLPLTFSGENIVKRIRSSQPKDNQSIRLVFELTQPAKTRAVTQRQGSSYNVVFTISGTQPVKASSAPAEVSSVSRPASSAPAENPFKGNPVTAVTSGDRVVAPGRSARSANDVVIVAIDAGHGGQDPGAIGAGGLKEKNVTIAIARKLKALLNDDPMFKGVMTRDGDYFISVMGRSDVARKQNANLLVSIHADAAPNRSASGASVWVLSNRRANSEMAGWLEQHEKQSELLGGAGDLLANSQADPYLSQAVLDLQFGHSQRVGYDVAVKVIAQLQRVGALHKRRPEHASLGVLRSPDIPSLLVETGFISNPSEERLLGSSAYQQKIAESIYKGLRNYFLAHPLQSVPKEENRPLQSAAVVNVETNPAPVNTQYSGVVSRHVVKRGETLSGIAAHYGVSTATLRGMNTLKNDVVWVGQRLKVPAGSSISKAASVSQAKKPVRHKVVRGDSLTAIAAHYGVSPKAIQQANNMKSQNVMLGQTLIIPAS

SEQ ID NO: 2893 - protein, 555 aa, unknown
  environmental sample
MMLRFKAWCLLALFCCSFSAVAANLSDIKVSNGSNEARVTLSFAGQPVYAFFPLHNPDRVVLDIRQSGIVQGLPLTFSGENIVKRIRSSTAKDSQSIRLVFELTQRGKTRAVTQRNGSHYNVVFTISGTQPSQASRQAAVSSVSPSRPVSTPPKSPFDANPVTSVSSGNEVARPRSARSSNDTVIVAIDAGHGGQDPGAIGGGGLKEKNVTIAIARKLKALLNADPMFKGVMTRDGDYFISVMGRSEVARKQNANLLVSIHADAAPNRSASGASVWVLSNRRANSEMAGWLEQHEKQSELLGGAGDLLANSQADPYLSQAVLDLQFGHSQRVGYDVAVKVIAQLQRVGALHKRRPEHASLGVLRSPDIPSLLVETGFISNPSEERLLGSSAYQQKIAESIYKGLRNYFLAHPLQSIPKEENRPLQAATAVEVQANPAPASTEYTGAVERHVVKRGETLSGIAASYGVSMETLRTMNTLKKDVVWVGQRLKVPAGSKTASAAAVSSRKPARHKVVRGDSLTAIAAKYGVSPQAIQQANKMKSQNVMLGQTLKIPTS

SEQ ID NO: 2894 - protein, 558 aa, unknown
  environmental sample
MMLRFKSWCLLALFCCSFSALSANLSDIKVSNGSNQAEVTLSFSSQPIYAFFPLHNPERVVLDIRQSAVVQGLPLTFSGENIVKRIRSSNAQDSQSIRLVFELTQRGKTRAVTKRSGSNYNVVFTISGTQPAQTASRSAPVSSATASRPVSSTPPKSPFDANPVTAVSSGNQVARPRSAASSNDTVIVAIDAGHGGQDPGAIGGGGLKEKNVTIAIARKLKALLNADPMFKGVMTRDGDYFISVMGRSDVARKQNANLLVSIHADAAPNRSASGASVWVLSNRRANSEMAGWLEQHEKQSELLGGAGDLLANSQADPYLSQAVLDLQFGHSQRVGYDVAVKVIAQLQRVGALHKRRPEHASLGVLRSPDIPSLLVETGFISNPSEERLLGSSAYQQKIAESIYKGLRNYFLAHPLQSIPKEENRPLQSAAAVEVEANPAPAGTEYSGPTQRHVVKRGETLSGIAANYGVSMATLRAMNTLKRDVVWVGQRLKVPAGSSGAATASVARSKKPLRHKVVRGDSLTAIAAKYGVSPQAIQQANKMKSQNVMLGQTLKIPTS

SEQ ID NO: 2895 - protein, 558 aa, unknown
  environmental sample
MMLRFKSWCLLALFCCSFSALSANLSDIKVSNGSNQAEVTLSFSSQPIYAFFPLHNPERVVLDIRQSAVVQGLPLTFSGENIVKRIRSSNAQDSQSIRLVFELTQRGKTRAVTKRSGSNYNVVFTISGTQPAQTASRSAPVSSATASRPVSSTPPKSPFDANPVTAVSSGNQVARPRSAASSNDTVIVAIDAGHGGQDPGAIGGGGLKEKNVTIAIARKLKALLNADPMFKGVMTRDGDYFISVMGRSDVARKQNANLLVSIHADAAPNRSASGASVWVLSNRRANSEMAGWLEQHEKQSELLGGAGDLLANSQADPYLSQAVLDLQFGHSQRVGYDVAVKVIAQLQRVGALHKRRPEHASLGVLRSPDIPSLLVETGFISNPSEERLLGSSAYQQKIAESIYKGLRNYFLAHPLQSIPKEENRPLQSAAAVEVEANPAPAGTEYSGPTQRHVVKRGETLSGIAANYGVSMATLRAMNTLKRDVVWVGQRLKVPAGSSSAATASVARSKKPLRHKVVRGDSLTAIAAKYGVSPQAIQHANKMKSQNVMLGQTLKIPTS

SEQ ID NO: 2896 - protein, 558 aa, Erwinia sp.
MMFRVKLAFILACCLVSFSSVAANLSDIQVSNGGSQATVTLSFNGQPVYGFFPLSKPDRVVLDIRQSGVIKGIPLNFSGDNIVKRIRSSTPKDSNSIRLVFELTQPARTRAVTQRNGNNYNVVFTINGTQTAQRSSSRPAEVSSATRNPVTSSAPAEPVSNPFNGNKVTAVTSGNTRVEPGRRASANDTVVVAIDAGHGGQDPGAIGANGLKEKNVTIAIARKLKALLNDDPMFKGVLTRDGDYFISVMGRSDVARKQNANVLVSIHADAAPNRSASGASVWVLSNRRANSEMANWLEQHEKQSELLGGAGDLLANSQADPYLSQAVLDLQFGHSQRVGYDVAVKVIAQLQSVGSLHKRRPEHASLGVLRSPDIPSLLVETGFISNPSEERLLGSSAYQEKIAQSIYKGLRNYFLSHPLQSFPKEENRPLQSAAAVNVEANSAPAGTTYTGATTRHVVQRGETLSGIAARYGVSMSTMRSLNNLKKDGVWVGQRLKVPADATRTAAVSSKPKKHKVVRGDSLTAIAAHYGVSSKAIMQANNMKSANVMLGQTLTIPAS

SEQ ID NO: 2897 - protein, 553 aa, Erwinia sp.
MMRRLMCWWMLALFCCSFASVAANLSDINVSNGSNEAQITLSFAGQPVYAFFPLHNPERVVLDVRQSAIVRGLPLDFSGDNIVKRIRASTAKDSHSIRLVFDLTRPGKTRAVTRREGSHYNVVFTISGSRTAAVASRNINASGNVNTRTSSPPKSPFDENRVTRVSSGNEVARPRRARSSNDTVIVAIDAGHGGQDPGAIGGGGLKEKNVTIAIAHKLKALLNADPMFKGVMTRDGDYFISVMGRSDVARKQNANLLVSIHADAAPARSASGASVWVLSNRRANSEMAGWLEQHEKQSELLGGAGDLLANSQTDPYLSQAVLDLQFGHSQRVGYDVAIKVIAQLQRVGALHKRKPEHASLGVLRSPDIPSLLVETGFISNPSEERLLGSSAYQQKIAESIYKGLRNYFLAHPLQSVPKEENRPLQFAAAVEPVINPVPAGTLSAAASQRHMVKRGETLSGIAAHYGVSMATLRAMNTLKNDVVWVGQRLKVPAASKAVSVAKREKSVKHKVVRGDSLTAIAAHYGVSPQAVQQANKLKSQNVMLGQTLTIPTS

SEQ ID NO: 2898 - protein, 555 aa, Pantoea sp.
MMLRVKLVIFMLLSLMAFSSLAATLSDIQVANGDRVATVTLRFSGQPVYGYFPLRNPNRVVLDIRQSGVIKGLPLTFSGDNLVKRIRSSQPKDSQSLRLVFELTQPAKTRAVTQQTSNGYQVVFTITGPAASRVSTPVSQPARNPVTAAPAPVTSQGNPFEGNKVTAVSSGNDRAVSGATISDNDTIVVAIDAGHGGQDPGAIGQRGLKEKNVTIAIARKLKVLLNNDRMFKGVLTRNGDYFISVMGRSDVARKENANLLISIHADSAPSHSASGASVWVLSNRRANSEMAGWLEQREKQSELLGGAGDLLANSQADPYLSQAVLDLQFGHSQRVGYDVAVKVIQQLQGVSPLHKHRPEHASLGVLRSPDIPSLLVETGFISNSSEERLLGSSAYQDKIAASIYRGLRNYFLAHPLQSAPKAENRPLESAEAVNVQPNVASDTTQYTGSTTRHVVKRGETLSGIAAHYGVSMSTLRSLNRLKKDVVWVGQRLKVPAGSAVSATASSAPKRHKVVRGDSLTAIAVHYGVSAKAIMQVNNMKSSNVMLGQTLTIPAS

SEQ ID NO: 2899 - protein, 558 aa, unknown
  environmental sample
MMTWMKMLVVAGLLLITGPLFAANLSDIQVSNGGNQATVTLSFSGQPVYAYFPLHNPDRVVLDIRQSGVIKGLPLTFSGDNIVKRIRTSTPKDKQSIRLVFELTQSGKTRAVTQRNGSQYSVVFTIQGKHPAVTRSAPVVAAEPAPTRARETAASNPFNANPVTTVTNTNSTVRPGGVASRNDTVIVAIDAGHGGQDPGAIGQHGLKEKNVTIAIARKLKVLLNDDPMFKGVLTRDGDYFISVMGRSDVARKANANVLVSIHADAAPSHAATGASVWVLSNRRANSEMANWLEQKEKQSELLGGAGDLLANSQADPYLSQAVLDLQFGHSQRVGYDIATKVIQQLRGVTSLHKRLPEHASLGVLRSPDIPSLLVETGFISNASEERLLGSSAHQDKIAQSIYKGLRAYFLAHPLQSVPKEENRPLATSPAVSVVSNPATGETQYTGAIQRHTVTRGETLSGIAAKYGVSMATLRQMNTLKRDVVWVGQRLKVPASAVASRTAPASSGAHRPVRHKVVRGDSLSSIAAHYGVSPKSILQANNLKSTNVMLGQNLKIPAS

SEQ ID NO: 2900 - protein, 556 aa, Plautia sp.
MQGTGMMSRVTGIMLALLCLFSSSALAATLSDMKVDNGDSQATVTLSFNGQPVYGFFPLHNPNRVVLDIRQSGNIQGLPLNFSGENIVKRIRNSQPKDNQSIRLVFELTQAAKTRASTQRDGNQYRVVFTISGTQPARRSTAAAPVTRARQSDSATTSQGNPFNANPVTAVTSSNTTVRPGGAVSRDEVIVAIDAGHGGQDPGASGQHGLHEKNVTIAIARKLKALMDQDPMFKPVLTRNGDYFISVMGRSEVARKENANLLVSIHADAAPNHSATGASVWVLSNRRANSEMANWLEQKEKQSELLGGAGDLLANSQADPYLSQAVLDLQFGHSQRVGYDVAVKVLQQLRGVTPLHKRLPEHASLGVLRSPDIPSLLVETGFISNAGEERLLGSSAYQEKIAQSIYKGLRNYFLAHPLQSVPKEENRPLDRAPAVSVASNPATGTVQYTGATQRHTVTRGETLSGIAARYGVSMATLRELNNLKRDVVWVGQRLKVPAGSGVSTAASRPARHKVVRGDSLTAIAAKYGVSPKAIMQANNMKSSNVMLGQNLKIPQS

SEQ ID NO: 2901 - protein, 556 aa, Pantoea sp.
MKSRMKLALVTLLLLVCAPLFAATLSDIKVANGDSQATVTLSFAGQPVYGFFPLRNPDRVVLDVRQSGVVQGLPLNFSGENIVKRIRTSTAKDKQSVRLVFELTQPGKTRAVTQRNGSSYSVVFTITGSRPAVTRPTPTPDPAPVRAPVQSAAAANPFNANPVTAVTSTASTVRPGSAVSRNDTVIVAIDAGHGGQDPGAIGQRGLKEKNVTIAIARKLRVLLNNDPMFKGVLTRDGDYFISVMGRSDVARKANANVLVSIHADAAPSHAATGASVWVLSNRRANSEMANWLEQKEKQSELLGGAGDLLANSQADPYLSQAVLDLQFGHSQRVGYDIAQRVLQQLRGVTSLHKRLPEHASLGVLRSPDIPSLLVETGFISNSSEERLLGSSAHQDKIAQSIYKGLRTYFLAHPLQSIPKEENRPLGSSPAVSVASNPATGVTQYTGATQRHTVTRGETLSGIAAKYGVSMATLREMNTLKRDVVWVGQRLKVPASAAVSRTTRATTRGVVRHKVVRGDSLTGIAAHYGVSPKAIMQTNNLKSTNVMLGQNLKIPAS

SEQ ID NO: 2902 - protein, 556 aa, unknown
  environmental sample
MMSRMKIALVSLLLLVCTPLFAATLSDIKVANGDSQATVTLNFAGQPVYAFFSLHNPNRVVLDVRQSGVVQGLPLNFSGENIVKRIRTSTPKDKQSVRLVFELTQAGKTRAVTQRNGNSYSVVFTITGKPPAVTRSVPAPVTAPTRVPTQSAAAANPFNSNPVTSVTSTASTVSPGRAVSQNDTVIVAIDAGHGGQDPGAIGQRGLKEKNVTIAIARKLRVLLNNDPMFKGVLTRDGDYFISVMGRSDVARKANANVLVSIHADAAPSHAATGASVWVLSNRRANNEMANWLEQKEKQSELLGGAGDLLANSQADPYLSQAVLDLQFGHSQRVGYDIAQKVLQQMRSVTSLHKRLPEHASLGVLRSPDIPSLLVETGFISNSSEERLLGSSAHQDKIAQSIYKGLRTYFLAHPLQSIPKEENRPLGSSPAVSVASNPATGVTQYTGATQRHTVTRGETLSGIAAQYGVSMNTLREMNTLKRDVVWVGQRLKVPASAVASRTTRATPRGVVRHKVVVGDSLTGIAAHYGVSPKAIMQTNNLKSTNVMLGQNLKIPAS

SEQ ID NO: 2903 - protein, 556 aa, unknown
  environmental sample
MMSRMKIALVSLLLLVCTPLFAATLSDIKVANGDSQATVTLNFAGQPVYAFFSLHNPNRVVLDVRQSGVVQGLPLNFSGENIVKRIRISTPKDKQSVRLVFELTQAGKTRAVTQRNGNSYSVVFTITGKPPAVTRSVPAPVTAPTRVPTQSAAAANPFNSNPVTSVTSTASTVSPGRAGSQNDTVIVAIDAGHGGQDPGAIGQRGLKEKNVTIAIARKLRVLLNNDPMFKGVLTRDGDYFISVMGRSDVARKANANVLVSIHADAAPSHAATGASVWVLSNRRANNEMANWLEQKEKQSELLGGAGDLLANSQADPYLSQAVLDLQFGHSQRVGYDIAQKVLQQMRSVTSLHKRLPEHASLGVLRSPDIPSLLVETGFISNSSEERLLGSSAHQDKIAQSIYKGLRTYFLAHPLQSIPKEENRPLGSSPAVSVASNPATGVTQYTGATQRHTVTRGETLSGIAAQYGVSMNTLREMNTLKRDVVWVGQRLKVPASAVASRITRATPRGVVRHKVVVGDSLTGIAAHYGVSPKAIMQTNNLKSTNVMLGQNLKIPAS

SEQ ID NO: 2904 - protein, 328 aa, Geobacillus sp.
MRRQLVLALLLGGSVFAAGARAEQAEASVNYDHIVPAAKQYIGVPYRWGGTTAKGFDCSGFIRHVYQSIGIDTPRTAADMYRMGKRVDKSALRVGDLVFFNTSGKGVSHAGIYIGNNRFIHSSSSKGVTISSLNDSYWKKTYIGAKRVLAYRLAPGQFQDVSPSHWAFDEVRTLSEQELVIGYEDSYFKPDEPITRAEVAAYLAEYLDLNLSDRSVPFNDVPDGYWALGAIRAVQKQGIMNGSNGQFHPEDTLTRAQLAAVLTRAFRLQPPAAAKSFTDVPPSFWAFRDIQALAAAGIATGRTDGSFGPNDPVTRVQFAAFLYRAMHQ

SEQ ID NO: 2905 - protein, 373 aa, Duganella sp.
MKTKIWFATMATGVLLLGTAQAQSYVYKNLTLPDGDGVARAINNQGQIVGSSYFEGVGNHATLWSGSTTIDLGSLGPSSSAARAINSSGQAVGYSLYTSTSLTASSWNTATGSMLALSPGTQSNARAINNAGQIAGYTTAADGSSRATIWNGNSTTYLSTLGGNDYALGINNHGVVVGDAYFTGSEASHAMVWDGDGARALGTLGGAGSDASAVNDNGKIVGSSQLANGSWQATLWDGDTISQLGASGYDGGQAWAINNRNQVVGYTYMDNNNDNGTRRAMLWDGGRMVDLTSFVDSESRAGGWVLTQAYGINDNGWIVGEAFNLQTNHRRAFLLSVSAVPEPSAYALLLMGLACMGMLNGRRVWGAKKSPPA

SEQ ID NO: 2906 - protein, 290 aa, Janthinobacterium sp.
MNRPFAFALLCASSLFVHLAAQAGEIRLYTDDNFKGRVVVLRDTTDDLSRVNFNDTVSSIQVDSGSWEVCTHADFKGDCKTLERGDYHSMPGMNDKISSVRETGAGQGSGSGGGRRAALELFADGGQRGASAGVNSDRDDLVDISFNDRASSARVEYGYWQLCSDSNYRGSCRVFGPGSHDDLGSLSGRVSSARLVDPREENRPQNDEGLVVLYGRAFLKGPGLQVNRDVSDLVRLNFNDQAASLAINEGTWEVCTDSQFNGSCERMGPGKYEVLNTTLDKRISSLRRLY

SEQ ID NO: 2907 - protein, 290 aa, Janthinobacterium sp.
MNRPFAFALLCASSLFVHLAAQAGEIRLYTDDNFKGRVVVLRDTTDDLSRVSFNDTVSSIQVDAGSWEVCTNADFKGDCKTLERGDYRSLPGMNDKISSVREIGGGQGSGGSGGRRAALELYADGGQRGASAGVNADRDDLVDISFNDRASSARIEHGYWQLCSDSNYRGSCRVFGPGSHDDLGSLNGRVSSARLVDPREENRPQNDEGLVVLYGRAFLKGPGLQVNRDVSDLVRLNFNDQAGSMTINEGTWEVCTDSQFNGTCERMGPGKYETLGTTLDKRISSLRRLY

SEQ ID NO: 2908 - protein, 290 aa, Janthinobacterium sp.
MNRPFAFALLCASSLFVHLAAQAGEIRLYTDDNFKGRVVVLRDTTDDLSRVNFNDTVSSIQVDSGSWEVCTHGDFKGDCKTLQRGDYRSMPGMNDKISSVREIGAGQGGGSGNGRRAALELYAGGGQRGASAGVNADRDDLVDIGFNDRASSARVEYGYWQLCSDSNYHGSCRVFGPGSHDDLGSLNGRVSSARLVDPREENRPQNDEGLVVLYGRAFLKGRRLQVNRDVSDLVLLNFNDQAESIAINEGTWEVCTNSQFNGTCERMGPGRYEVLDTALDKRISSLRRLY

SEQ ID NO: 2909 - protein, 154 aa, Janthinobacterium sp.
MAPDRRGTLNLAAVMLAAGLLLGSAAQAQTDSALPPVQKSGAVEYLSGGIGLDESTAIQSASPHWPLSLVFSVQAAGKAEFASDVKLEIRDAKGGVALETTASGPFLLAKLPPGRYSLRATLAGKALERKVQVKAGSSARVELVWPAGTNQGRP

SEQ ID NO: 2910 - protein, 154 aa, Janthinobacterium sp.
MALNRRGTLGLAAAMLAAGLLLGSAAQAQTDGALPPVQKNGAVEYLSGGIGLDESTAIKSASRHWPLSLVFSVQAAGKAEFASDVKLEIRDAKGASVLDTTASGPFLLAKLPPGSYSLRATLAGKTLERKVQIKAGSSARVELVWPAGTNQGRP

SEQ ID NO: 2911 - protein, 154 aa, Janthinobacterium sp.
MALNRRGTLGLAAAMLAAGLLLGSAAQAQTDGALPPVQKNGAVEYLSGGIGLDESTAIKSASRHWPLSLVFSVQAAGKAEFASDVKLEIRDAKGAPVLDTTASGPFLLAKLAPGSYSLRATLAGKSLERKVQIKAGSSARVELVWPAGTNQGRP

SEQ ID NO: 2912 - protein, 156 aa, Janthinobacterium sp.
MASNRRRRGTLGLAAAMLAAGLLLGSAAQAQTDSALPPVQKSGAVEYLSGGIGLDESTAIKSASRHWPLSLVFSVQAAGKAEFASDVKLEIRDAKGAPVLETTASGPFLLAKLAPGSYSLRATLAGKTLERKVQIKAGSSARVELIWPAGTNQGKS

SEQ ID NO: 2913 - protein, 438 aa, Lysobacter sp.
MSHNPLLELMYRGESGAAGYNAYNRGTYIGTDGKEHIRGPNGPIDFSQMTVGQLMDRQALPNGNADRVFAVGKYQIIPDTMSDSVSALGIDRNARFTPELQDKIFKEYLIVDKRPEIADYITGKPGATLAEAQHGLSKEWASFGDPNKNGASHYGGANHASITLQQSADALNQMRTEYKANIDKGLSPADAWKATTGDDPNRTLPASITSPGSSQRAPRDAMADGVLKPDERGPAVTSLQEQLNKAGFRDAQGNELKPDGHYGKHTKEAVEAFQRANNLEVDGKAGPKTLEALKNAQPAGPQTEKPAEKPGEVQLSNPAHPDHAMYKQAVAGLEKLGPQAGFKDHAALERAAGTMTYEARVSGMTKIDHVVPNASGTGLFAVQGELRDPASQRVVVDKAQASSQSIEQSTQQLKQDAPTQNQTQEPAQERQQPKTMMA

SEQ ID NO: 2914 - protein, 123 aa, Paenibacillus sp.
MDNKAYVSQTYPRLTVYNEENFRGSRRVFRGNLGIRNTDNILDGIESLRFFSTSSNATLVLFTGTRFRGNFRVFRGNRSIADLDDLIRGNDVESIISTNQRLTLQQIRNIRSSGRLPSGYRII

SEQ ID NO: 2915 - protein, 123 aa, Paenibacillus sp.
MDNKAYVSQTYPRLTVYNEENFRGSRRVFRGNLGIRNTDNILDGIESLRFFSTSSNATLVLFTGTRFRGNFRVFRGNRNIADLDDLIRGNDVESIISTNQRLTLQQIRNIRSTGRLPAGYRII

SEQ ID NO: 2916 - protein, 123 aa, Paenibacillus sp.
MTNKAYVSQTYPRLTVYNEENFRGSRRVFRGNLGIRNTDNILDGIESLRFFSTSSNATLVLFTGTRFRGNFRVYRGNRSIADLDDLIRGNDVESIISTNQRLTLQQIRNIRSTGRLPSGYRII

SEQ ID NO: 2917 - protein, 123 aa, Paenibacillus sp.
MTNKAYVSQTYPRLTVYNEENFRGSSRVFRGNLGIRNTDNILDGIESLRFFSTSSNATLVLFTGTRFRGNFRVYRGNRSIADLDDLIRGNDVESIISTNQRLTLQQIRNIRSTGRLPSGYRII

SEQ ID NO: 2918 - protein, 123 aa, Paenibacillus sp.
MTDKAYVSQTYPRLTVYNEENFRGSSRVFRGNLGIRNTDNILDGIESLRFFSTSSDATLVLFTGTRFRGNFRVYRGNRRIADLDDLIRGNDVESIISTNQRLTLQQIRNIRSSGRLPSGYRII

SEQ ID NO: 2919 - protein, 123 aa, Paenibacillus sp.
MKKEVHVSQTYPRLTVYDEENFNGRRRIYTGNLGIRNTDNILDGIESLRFFSTSSNATLVLFTRTRFRGNFRVLRGNRNIRDLDDFISGNDVESIISTNQRLTLEQIRNIRSSGNLPSGYRLI

SEQ ID NO: 2920 - protein, 123 aa, Paenibacillus sp.
MKKEVHVSQTYPRLTVYDEENFRGRSRIYTGNLGIRNTDNILDGIESLRFFSTSSNATLVLFTRTRFRGNFRVLRGNRSIRDLDDFISGNDVESIISTNQRLTLEQIRNIRRTGNLPSGYRLI

SEQ ID NO: 2921 - protein, 123 aa, Paenibacillus sp.
MISKAFVSQTYPRLTVFSEENFRGASRVYTGNLGIRDMDTVLDGIESLRFFSTSSDATLVLFTGTRFRGNFQVFRGNRRFADLDGLIRGNDVESLVSTNQRLTLQQIRNIRSTGKLPSGYRLI

SEQ ID NO: 2922 - protein, 123 aa, Paenibacillus sp.
MNKEVHISQTYPRLTVYSEENFRGRSRIYRGNLGIRDTDNILDGIESLRFFSTSSNATLVLFSRTRFRGSFRVLRGNHSIRDLDDFISGNDVESIISTNQRLTLDQIRRIRSSGELPPGYRLI

SEQ ID NO: 2923 - protein, 123 aa, Paenibacillus sp.
MNKEVHISQTFPRLTVYSEENFRGRSRIYRGNLGIRNTDNILDGIESLRFFSTSSNATLVLFSRTRFRGSFRVLRGNHSLRDLDDFISGNDVESIISTNQRLTLDQIRRIRSSGELPAGYRLI

SEQ ID NO: 2924 - protein, 123 aa, Paenibacillus sp.
MRKLVHASQTYPRLTVYEDENYRGRSRVYTGNLGIRNTDAILDGIESLRFFSTNSNATLVLFTRTRFRGNFRVLRGNHSISDLEDYINGNDVESLIATNQRLTLTQIRNIRSSGDLPSGYRLI

SEQ ID NO: 2925 - protein, 123 aa, unknown
  environmental sample
MRKPVSILQTYPRLTVYDEENFRGRSRILRGNLGIRDLDNVLDGIESLRFFSTSSNATLVLFTRTRFRGNFRILRGNRSIRDLDDLIGGNDVESLISTNQRLTAAQVRAIRRSGQLPSGYRLI

SEQ ID NO: 2926 - protein, 123 aa, Paenibacillus sp.
MQPKAYVSQTYPRLTVYEDEGFTGRSRVFTGNVGISNTDRIVDGIESLRFFSTSSNATLVLFTRTGFRGNFRILRGNRSIRDLDDLIAGNDVESIISTNQRLTVEQVRAIRNAGQLPAGYTRV

SEQ ID NO: 2927 - protein, 123 aa, Paenibacillus sp.
MKKQVSISQTYPRLRVFDEENFRGRRRTLRGNLGIRDLDNILDGIESLSFFSTNPNATLVLFTRTRFRGNFRILRGNRSIRDLDDLIGGNDVESLISTNQRLTIAQVREIRRTGRLPQGYRLI

SEQ ID NO: 2928 - protein, 123 aa, Paenibacillus sp.
MKKTVNVSQTYPRLTVYSEENYRGRSRIYRGNTGLRNLDNILDGVESLRFFSTSSNATLVVFTRPNFQGGFRVFRGNTNLRDLDDLIRGNDVESLISTNQRLTLAQIRAIRRDRSLPSGYNLV

SEQ ID NO: 2929 - protein, 125 aa, Paenibacillus sp.
MIESQKVSISQRFPLLTVYSEENFRGARRIFTGNLGIRNLDRVLGGIESLRFFSTNPNATLVLFTRTRFRGNFRILRGNRSIRDLDDLIAGNDVESLISTNQRLTVAQVRNIRNTGTLPPGYRVI

SEQ ID NO: 2930 - protein, 348 aa, Paenibacillus sp.
MLATFSAALQVKKRMAKRVLKMSGVHGIGVGYRDPAHPKKGAAVIVYTDRLASASTGLLSATALGKKTNVPVRIVKTGKIRANATDYKVRIRPVIAGYSVGTIEGSGSTGLIVAPTGAPATRYLFSNNHVLNPSNTDNREATIQPGGADGGTVTQDRIGRLYRYVRLNPTGTNLIDAALSLPTRNNLLNPRYATVGAIPGHVTAYRIGERLKKVGRTTGRVNGTVESVYTDLQINYGGELGLLTFEDQTVIRGTTPVSLPGDSGSVWLRQSDNYAAAVNYAGTADGRLSIAFPVQWAMQVFNTRVARPNGAGRVLRVDTGSSPRSYTRQLTSEELVRLRPRTTRIRRS

SEQ ID NO: 2931 - protein, 348 aa, Paenibacillus sp.
MLATFSAALQVKKRMAKRVLKMSGVHGIGVGYRDPAHPKRGAAVIVYTDRLASASTGLLSATALGKKTNVPVRIVKTGKIRANATDYKVRIRPVIAGYSVGTIEGSGSTGLIVAPTGAPATRYLFSNNHVLNPSNTDNREATIQPGGADGGTVTQDRIGRLYRYVRLNPTGTNLIDAALSLPTRNNLLNPRYATVGAIPGHVTAYRIGERLKKVGRTTGRVNGTVESVYTDLQINYGGELGLLTFEDQTVIRGTTPVSLPGDSGSVWLRQSDNYAAAVNYAGTADGRLSIAFPVQWAMQVFNTRVARPNGAGRVLRVDTGSSPRSYTRQLTSEELVRLRPRTTRIRRS

SEQ ID NO: 2932 - protein, 347 aa, Paenibacillus sp.
MATFSAALQVKKRMAKRVLKMSGVHGIGVGYRDPAHPKRGAAVIVYTDRLASASTGLLSATALGKKTNVPVRIVKTGKIRANATDYKVRIRPVIAGYSVGTIEGSGSTGLIVAPTGAPATRYLFSNNHVLNPSNTDNREATIQPGGADGGTVTQDRIGRLYRYVRLNPTGTNLIDAALSLPTRNNLLNPRYATVGAIPGHVTAYRIGERLKKVGRTTGRVNGTVESVYTDLQINYGGELGLLTFEDQTVIRGTTPVSLPGDSGSVWLRQSDNYAAAVNYAGTADGRLSIAFPVQWAMQVFNTRVARPNGAGRVLRVDTGSSPRSYTRQLTSEELVRLRPRTTRIRRS

SEQ ID NO: 2933 - protein, 348 aa, Paenibacillus sp.
MLATFSAALQVKKRMAKRVLKMSGVHGIGVGYRDPAHPKRGAAVIVYTDRLASASTGLLSATALGKKTNVPVRIVKTGKIRANATDYRVRIRPVIAGYSVGTIEGSGTTGLIVAPTGAPATRYLFSNNHVLNPSNTDNREATIQPGGADGGTVAQDRIGRLYRYVRLNPTGTNLIDGALSLPTRNNLLNPRYATVGAIPGHVTAYRIGDRLKKVGRTTGRVNGTVESVYTDLQINYGGELGLLTFEDQTVIRGTTPVSLPGDSGSVWLRQSDNYAAAVNYAGTADGRLSIAFPVQWAMQVFNTRVARPNGAGRVLRVDTGSSPRSYTRQLTSEELARLRPRTTRIRRS

SEQ ID NO: 2934 - protein, 348 aa, Paenibacillus sp.
MLATFSAALQVKKRMAKRVLKMSGVHGIGVGYRDPAHPKRGAAVIVYTDRLASASTGLLSATALGKKSNVPVRIVKTGKIRANATDYKVRIRPVIAGYSVGTIEGSGTTGLIVAPTGAPATRYLLSNNHVLNPSNTDNREATIQPGGADGGTVAQDRIGRLYRYVRLNPTGTNLIDAALSLPTRNNLLNPRYATVGAIPGHVTAYRIGERLKKVGRTSGRVNGTVESVYTDLQINYGGELGLLTFEDQTVIRGTTPVSLPGDSGSVWLRQSDNYAAAVNYAGTADGRLSIAFPVQWVMQVFNTRVARPSGAGRVLRVDTGSSPRSYTRQLTSEELVRLRPRTTRIRRS

SEQ ID NO: 2935 - protein, 348 aa, Paenibacillus sp.
MLATFSAALQVKKRMAKRVLKMSGVHGIGVGYRDPAHPKRGAAVIVYTDRLVSASTGLLSATTLGKKTNVPVRIVKTGKIRANATDYRVRIRPVIAGYSVGTIEGSGTTGLIVAPTGAPATRYLFSNNHVLNPSNTDNREATIQPGGADGGTVTQDRIGRLYRYVRLNPTGTNLIDTALSLPTRNNLLNPRYATVGALPGHVTAYRIGDRLKKVGRTTGRVNGTVESVYTDLQINYGGELGLLTFEDQTVIRGTTPVSLPGDSGSVWLRQSDNYAAAVNYAGTVDGRLSIAFPVQWFMQVFNTRVARPNGAGRVLRVDTGSSPSSYTRQLTSEELARLRPRTTRIRRS

SEQ ID NO: 2936 - protein, 348 aa, Paenibacillus sp.
MLATFSAALQVKKRMAKRVLKMSGVHGIGVGYRDPAHPKRGAAVIVYTDRLASASTGLLSATALGKKSNVPIRIVKTGKIRANATDYRVRIRPVIAGYSVGTIEGSGTTGLIVSPTGEPATRYLFSNNHVLNPSNTDNREATIQPGGADGGTVAQNRIGRLYRYVRLNPTGTNLIDAALSLPTRNNLLNPRYATVGAIPGHVTAYRVGEKLKKVGRTTGRVNGTVESVYTDLQINYGGELGLLTFEDQTVIRGTTPVSLPGDSGSVWLRQSDNYAAAVNYAGTADGRLSIAFPVQWFMQVFNTRVARPSGAGRVLRVDTGSSPRSYTRQLTSEELVRLRPRTTRIRRS

SEQ ID NO: 2937 - protein, 348 aa, Paenibacillus sp.
MLATFSAALQVKKRMVKRVLKMSGVHGIGVGYRDPAHPKRGAAVIVYTDRLASASTGLLSATALGKKSNVPIRIVKTGKIRANATDYRVRIRPVIAGYSVGTIEGSGTTGLIVSPTGEPATRYLFSNNHVLNPSNTDNREATIQPGGADGGTVAQNRIGRLYRYVRLNPTGTNLIDAALSLPTRNNLLNPRYATVGAIPGHVTAYRVGEKLKKVGRTTGRVNGTVESVYTDLQINYGGELGLLTFEDQTVIRGTTPVSLPGDSGSVWLRQSDNYAAAVNYAGTADGRLSIAFPVQWFMQVFNTRVARPSGAGRVLRVDTGSSPRSYTRQLTSEELVRLRPRTTRIRRS

SEQ ID NO: 2938 - protein, 347 aa, Paenibacillus sp.
MATFSAALRVKKRMAKRVLKLSGVHGIGVGYKDPGHPKKGAAVIVYADRLASASTGLLSATALGKKTNVPVRIVKTGKIRANATDYRARIRPVIAGYSVGTIEGSGTTGLIVAPTGAPATRYLFSNNHVLNPSNTDNREATIQPGGADGGTVPRDRIGRLYRYVRLNPSGTNLIDTALSLPTRNSLLSPRYATVGTIPGHVTAYRIGERLKKVGRTTGRVNGTVESVYTDLQINYGGSLGLLTFEDQTVIRGTNPVSLPGDSGSVWLRQSDNYAAAVNYAGTADGRLSIAFPVQWFMQVFNTRVARPNGAGRVLTVDTGSSPSSYTRQLTSEELARLRPRTTRIRKG

SEQ ID NO: 2939 - protein, 348 aa, Paenibacillus sp.
MMATFSAALRVKKRMAKRILKLSGVHGIGVGYKDPAHPKKGAAVIVYADQLASASTGLLSATALGKKTNVPIRIVKTGKIRANATDYKTRIRPVIAGYSVGTIEGSGTTGLIVAPTGAPATRYLFSNNHVLNPSNTDNREATIQPGGADGGTVSQDRIGRLYRYVRLSPSGTNLIDTALSLPTRNRLLNPRYATVGVVPGHVTAYRVGERLKKVGRTTGRVNGTVESVNTDLQINYGGSLGLLTFEDQTVVRGTTPVSLPGDSGSVWLRQSDNYAAAVNYAGTADGRLSIAFPVQWFMQVYNTRVARPNGAGRVLTVDTGSSPSSYTRQLTSEELARLRPRTTRIRKS

SEQ ID NO: 2940 - protein, 348 aa, Paenibacillus sp.
MLATFSAALQVKKRMAKRILKLSGVHGIGIGYKDPAHPKKGAAVIVYTDRLASASAGLLSATALGKKTNVPVRIVKTGKIKAHAADYRKRIRPVVAGYSVGTIEGSGTTGLIVAPTGAPATRYLFSNNHVLNPSNTDNREATIQPGGADGGTVARDRIGRLYRYVRLNPNGTNLIDTALALPTSNSLLSPRYATVGAVPGHVTAYRVGEKLKKVGRTSGRVNGTVESVYTDLQINYGGSLGLLTFEDQTVIRGTTPVSLPGDSGSVWLRQSDNYAAAVNFAGTADGRLSIAFPVQWFMQVFNTRVARPNGAGRVLTVDTGSSPRFYTRQLTSEELARLRPRTTRIRKS

SEQ ID NO: 2941 - protein, 348 aa, Paenibacillus sp.
MLATFSAALQVKKRMAKQVLKMSGVHGIGVGYRDPARPKRGAAVIVYTDRLATASTGLLSATALGKQTSVPVRIVKSGKIKAHATDYKVRIRPVIAGYSVGTIEGSGTTGLIVAPTGAPATRYLFSNNHVLNPSNTDNREATIQPGGADGGAATRDRIGRLYRYIRLNPTGTNFIDAALSLPPRNSSLSPRYATVGAVPGHVTAYRVGEKFKKVGRTTGRVNGTVESVYTDLQINYGGSLGLLTFQDQTVIRGTTPVSLPGDSGSVWLRQSDNYAAAVNFAGTTDGRLSIAFPVQWFMQAFNTRVARPVGAGRVRRVDTGSSPRSYTRQLTGEELARLKPRTTRIRRS

SEQ ID NO: 2942 - protein, 349 aa, Paenibacillus sp.
MMLATFSAALQVKKRMAKRVLKMSGVHGIGVGYRDPAHPKRGAAVIVYTDRLTTASTGLLSATALGKQTSVPVRIVKSGKMKAHATDYMTRIRPVIAGYSVGTIEGSGTTGLVVAVTGTPATRYLFSNNHVLNPSNTDNREATLQPGGADEGTATRDRIGRLYRYVRLNPTGTNFIDAALSLPTRNSLLSPRYATVGVVPGHVTAYRVGERFKKVGRTTGLVNGTVESVYTDLQINYGGSLGLLTFEDQTVIRGTTPVSLPGDSGSVWLRQSDNYAAAVNFAGTADGRLSIAFPVQWFMQAFNTRVARPVGAGRVRRVDTGSSPRSYTRQLTSEELARLKPRTTRIRRS

SEQ ID NO: 2943 - protein, 348 aa, Paenibacillus sp.
MLATFSAALQVKKRMAKQVLKMSGVHGIGVGYRDPARPKRGAAVIVYTDRLAPASTGLLSATALGKQTSVPVRIVKSGKMKAHATDYMTRIRPVIAGYSVGTIEGSGTTGLIVAPTGAPATRYLFSNNHVLNPSNTDNREATLQPGGADGGTDTRDRIGRLYRYIRLNPKGTNFIDAALSLSTRNSMLSPRYATVGVVPGHVTAYRVGEKFKKVGRTTGVVNGTVESVYTDLQINYGGSLGLLTFQDQTVIRGTTPVSLPGDSGSVWLRRSDNYAAAVNFAGTADGRLSIAFPVQWFMQAFNTRVARPVGAGQVRRVDTGSSPRSYTRQLTSKELARLQPRTTRIKKS

SEQ ID NO: 2944 - protein, 345 aa, Paenibacillus sp.
MSRFAPLFTAPVARMSALNIGTCEEEGVNVSLLDQADREIQAKFPKMHSFLLLRHGKLIWERYYNGHEVSSLNDLRSATKSFTSTLIGIAMARGDMPGPETAVHKLLPEYLPRRKETLLEQITIRHLLTMTSGLYWQTGKKLGEAFIHRFHRSKSWPSFALRLPVQEDQLGVFQYRSVDSHLLSVLLTHCCGIDAYTYALQYLFEPLGFGRSGWAQDPEGYTMGHIGLYLTSRDMAKFGDCCLHQGSWNGTELIPADWLHQATQRQVEGYPEFGDYGFQWWTGRLHGINYACAHGHGGQQIYLVPEANAVAIFTADSKVSRWKNPRTLLERYVLPAVSSLNLERS

SEQ ID NO: 2945 - protein, 345 aa, Paenibacillus sp.
MSRFAPLFTGPVARMSALNIGTCEEEGVNVSLLDQADREIQAKFPKMHSFLLLRHGKLIWERYYNGHEVSSLNDLRSATKSFTSTLIGIAMARGDMPGPETAVHKLLPEYLPRRKETLLEQITIRHLLTMTSGLYWQTGKKLGEAFIHRFHRSKSWPSFALRLPVQEDQLGVFQYRSVDSHLLSVLLTHCCGIDAYTYALQHLFEPLGFGRSGWAQDPEGYTMGHIGLYLTSRDMAKFGDCCLHQGSWNGKELIPADWLHQATQRQVEGYPEFGDYGFQWWTGRLHGINYACAHGHGGQQIYLVPEANAVAVFTADSKVSRWKNPRTLLERYVLPAVSSLNLERS

SEQ ID NO: 2946 - protein, 345 aa, Paenibacillus sp.
MSRFAPLFTAPVARMSALNIGTCEEEGVNVSLLDQADREIQAKFPKMHSFLLLRHGKLIWERYYNGHEVSSLNDLRSATKSFTSTLIGIAMARGDMPGPETAVHKLLPEYLPRRKEILVEQITIRHLLTMTSGLYWQTGKKLGEAFIHRFHRSKSWPSFALRLPVQEDQLGVFQYRSVDSHLLSVLLTHCCGIDAYTYALQHLFEPLGFGRSGWAQDPEGYTMGHIGLYLTSRDMAKFGDCCLHQGSWNGKELIPADWLHQATQRQVEGYPEFGDYGFQWWTGRLHGINYACAHGHGGQQIYLVPEANAVAVFTADSKVSRWKNPRTLLERYVLPAVSSLNLERS

SEQ ID NO: 2947 - protein, 345 aa, Paenibacillus sp.
MSRFAPLFTAPVARMSALNIGTCEEEGINVSLLDQADREIQAKFPKMHSFLLLRHGKLIWERYYNGHEASSLNDLRSATKSFTSTLIGIAMARGDMPGPETAVHKLLPEYLPRRKETLLEQITIRHLLTMTSGLYWQTGKKLGEAFIHRFHRSKSWPSFALRLPVQEDQLGVFQYRSVDSHLLSVLLTHCCGIDAYTYALQHLFEPLGFGRSGWAQDPEGYTMGHIGLYLTSRDMAKFGDCCLHQGSWNGKELIPADWLHQATQRQVEGYLEFGDYGFQWWTGRLHGINYACAHGHGGQQIYLVPEANAVAVFTADSKVSRWKNPRTLLERYVLPAVSSLNLERS

SEQ ID NO: 2948 - protein, 345 aa, Paenibacillus sp.
MSRYAPLFTAPVARMSALNIGTCEEEGINVSLLDQADREVQAKFPKMHSFLLLRHGKLIWERYYNGHEASSLNDLRSATKSFTSTLIGIAMARGDMPGPETAVHKLLPEYLPRRKETLLEQITIRHLLTMTSGLYWQTGKKLGEAFIHRFHRSKSWPSFALRLPVQEDQLGVFQYRSVDSHLLSVLLTHCCGIDAYTYALQHLFEPLGFGRSGWAQDPEGYTMGHIGLYLTSRDMAKFGDCCLHQGSWNGKELIPADWLHQATQRQVEGYPEFGDYGFQWWTGRLHGINYACAHGHGGQQIYLVPEANAVAVFTADSKVSRWKNPRTLLERYVLPAVSSLNLERS

SEQ ID NO: 2949 - protein, 345 aa, Paenibacillus sp.
MSRYAPLFTAPVARMSALNIGTCEEEGINASLLDQADREVQAKFPKMHSFLLLRHGKLIWERYYNGHEASSLNDLRSATKSFTSTLIGIAMARGDMPGPETAVHKLLPEYLPRRKETLLEQITIRHLLTMTSGLYWQTGKKLGEAFIHRFHRSKSWPSFALRLPVQEDQLGVFQYRSVDSHLLSVLLTHCCGIDAYTYALQHLFEPLGFGRSGWAQDPEGYTMGHIGLYLTSRDMAKFGDCCLHQGSWNGKELIPADWLHQATQRQVEGYPEFGDYGFQWWTGRLHGINYACAHGHGGQQIYLVPEANAVAVFTADSKVSRWKNPRTLLERYVLPAVSSLNLERS

SEQ ID NO: 2950 - protein, 345 aa, Paenibacillus sp.
MRRYAPLFTAPVARMSALNIGTCEEEGINVSLLDQADREIQAKFPKMHSFLLLRHGKLIWERYYNGHEVSSLNDLRSATKSFTSTLIGIAMARGDMPGPETAVHKLLSEYLPRRKETLLEQITIRHLLTMTSGLYWQTGKKLGEAFIHRFHRSKSWPSFALRLPVQEDQLGVFQYRSVDSHLLSVLLTQCCGIDAYTYALQHLFEPLGFGRSGWAQDPEGYTMGHIGLYLTSRDMAKFGDCCLHQGSWNGKELIPADWLHQATQRQVEGYPEFGDYGFQWWTGRLHGINYACAHGHGGQQIYLVPEANAVVVFTADSKVSRWKNPRTLLERYVLPAVSFLNLERS

SEQ ID NO: 2951 - protein, 345 aa, Paenibacillus sp.
MSRYAPLFTAPVARLSALNLGTCEEEGIDASLLDQADHEIRAKFPKMHSFLLLRHGKLIWERYYNGHEASALNDLRSATKSFTSTLVGMAMARGDMPGPDTAVHKLLPEYLPRRKETLLERITIRHLLTMTSGLYWQTGKKLGEAFIHRFHRSKSWPSFALRLPVQEDQIGVFQYRSVDSHLLSVLLTRCCGMDAYTYALQHLFEPLGFGRSGWAQDPEGYTMGHIGLYLTSRDMAKFGDCCLHQGIWNGRELIPADWLHQATQRQIEGYPEFGDYGFQWWTGRLHGIDYACAHGHGGQQIYLIPEANAVVVFTADSKVSRWKNPRTLLERFVLPAVSSLNLERS

SEQ ID NO: 2952 - protein, 345 aa, Paenibacillus sp.
MSRYAPLFTAPVARLSALNLGTCEEEDIDASLLDQADHEIRAKFPKMHSFLLLRHGKLIWERYYNGHEASSLNDLRSATKSFTSTLVGIAMARGDMPGPETAVHKLLPEYLPKRKETLLERITIRHLLTMTSGLYWQTGKKLGEAFIHRFHRSKSWPSFALRLPVQEDQIGVFQYRSVDSHLLSVLLTRCCGIDAYTYALKHLFEPLGFGRSGWAQDPEGYTMGHIGLYLTSRDMAKFGDCCLHQGIWNGRELIPADWLHEATQRQIEGYPEFGDYGFQWWTGRLHGIDYACAHGHGGQQIYLIPEANTVVVFTADSKVSRWKNPRTLLERFVLPAVSSLNLERS

SEQ ID NO: 2953 - protein, 345 aa, Paenibacillus sp.
MSRYAPLFTAPVARLSALNLGTCEEEGIDASLLDQADHEIRAKFPKMHSFLLLRHGKLIWERYYNGHEASALNDLRSATKSFTSTLVGMAMARGDMPGPDTSVHKLLPEYLPRRKETLLERITIRHLLTMTSGLYWQTGKKLGEAFIHRFHRSKSWPSFALRLPVQEDQIGVFQYRSVDSHLLSVLLTRCCGMDGYTYALQHLFEPLGFGRSGWAQDPEGYTMGHIGLYLTSRDMAKFGDCCLHQGIWNGRELIPADWLHQATQRQIEGYPEFGDYGFQWWTGRLHGIDYACAHGHGGQQIYLIPEANAVVVFTADSKVSRWKNPRTLLERFVLPAVSSLNLERS

SEQ ID NO: 2954 - protein, 345 aa, Paenibacillus sp.
MRRYAPLFTAPVARLSVLITGTCEEEGVNASLLDQADHEIEKKFTKMRSFLLLRRGKLIWERYYNGHEASALNDLRSATKSFTSTLIGIAMARGDMPGPETAVHKLLPEYLPRRESPLLERITIRHLLTMTSGLYWQTGKKLGEAFIRRFHRSKSWPSFALRLPVQADQLGVFQYRSVDSHLLSVLLTQCCGTDAYTFALHHLFEPLGFGRSRWAQDPEGYTMGHIGLYLTSRDMAKFGDCCLHQGCWNGQELISADWLRQATQRQVEGYPEFGDYGFQWWTGRLHGINYACAHGHGGQQIYVVPEADAVVVFTADSKVSRWKNPRSLLERYILPAISSLSLERS

SEQ ID NO: 2955 - protein, 259 aa, Paenibacillus sp.
MNHRTNHSPKDKRTARRNLSHAVPSPRVNKERAASTSGSHKSNQRGTATVPAPVEKDTSVQAIEEAAWKKHKLPKTLEEAMQMNRASVLLLSVPESDTEYRTDNDISSITTEEQAEQDSLLDCSITSIHIAEGRPRLKQRMVLSEQDIDLAFDTEKELNLNAIHDGSATSDEASDDHIASPQYGSISFHLPAQADRGEVSVVFEKPFIDTQYVITANASIPGVMVSVTQRQRYSAVLTVERIHSGPLCEGLVLWIAMGQ

SEQ ID NO: 2956 - protein, 259 aa, Paenibacillus sp.
MNHRTNHSPKDKRTARRNLSHAVPSPRVNKEKAASTSGSHKSNQRGTATVSAPVEKDTSVQAIEEAAWKKHKLPKTLEEAMQMNRASVLLLSVPESDTEYRTDNDISSITTEDQSEKDSLLDCSITSIHIAEGRPRPRQRVVLSEQDIDLAFDTEKELSLNAIHDGSATSDEASDDHIASPQYGSISFHLPAQADRGEVSVVFEKPFIDTQYVITANASIPGVMVSVTQRQRYSAVLTVERIHSGPLCKGLVLWIAMGQ

SEQ ID NO: 2957 - protein, 259 aa, Paenibacillus sp.
MNHRTNHSPKDKRTARRNLSNAVPSPRVNKEKAASTSGSHRPSQRGTATVPVPVEKDTSVQAVEEAAWKKHKLPKTLEEAMQMNRASVLLLSVPESDTEYRTDNDIPSITTEDQAEQDSLLDCSITSIHIAEGRHRPKQRVVLPEQDIDLAFDTEKELDLNAIHDGSATSDEASDDHIASPQYGSISFHLPEQADRGEVSVVFEKPFIDTQYVITANASIPGVMVSVTQRQRYSAVLTVERIHSGPLCEGLVLWIAMGQ

SEQ ID NO: 2958 - protein, 259 aa, Paenibacillus sp.
MNHRTNHSPKDKRTARRNLSNAVPSPRVNKEKAASTSGSHRLSQRGTATVPAPVEKDTSVQAIEEAAWKKHKLPKTLEEAMQMNRASVLLLSVPESDTEGRMDNDKPSITTEDQAEQDSLLDCSITSIHIAEGRHRPKQRVVLPEQDIDLAFDTEKELNLNAIHDGSATSDEASDDHIASSQYGSISFHLPARADRGEVSVIFEKPFIDTQYVITASASIPGVLVSVTQRQRYSAVLTVERIHSGPICEGLVLWIAMGQ

SEQ ID NO: 2959 - protein, 259 aa, Paenibacillus sp.
MNHRTNHSPKDKRTARRNIPHAVPSPRVNKEKAASTSGSHRPSQRGRETVPAPVEKDTSVQAIEEAAWKKHKLPKTLEEAMHMNRASVLLLSVPESDTEYRTDNDIPSITTEGQAEQDSLLDCSITSIHIAEGRHRPKQRVVLPEQDIDLAFDTEKELDLNAVHDGSATGDEASDDHIASSQYGSNSFHLPARADRGEVSVVFEKPFIDTQYVITANASIPGVMVSVTQRQRYSAVLTVERIHSGPICEGLVFWIAMGQ

SEQ ID NO: 2960 - protein, 282 aa, Paenibacillus sp.
MIPSRVNEAERPLVHSCAKGAITMNHRTNHSPKDKRTARRNIPHAVPSPRVNKEKAASTSGSHRPSQRGRETVPAPVEKDTSVQAIEEAAWKKHKLPKTLEEAMHMNRASVLLLSVPESDTEYRTDNDIPSITTEGQAEQDSLLDCSITSIHIAEGRHRPKQRVVLPEQDIDLAFDTEKELDLNAVHDGSATGDEASDDHIASSQYGSNSFHLPARADRGEVSVVFEKPFIDTQYVITANASIPGVMVSVTQRQRYSAVLTVERIHSGPICEGLVFWIAMGQ

SEQ ID NO: 2961 - protein, 258 aa, Paenibacillus sp.
MNHRMNHGHKDKKIARRNLSNTVPSPRVSKEKPASLAGSHRTTQRGTASAAVPVEKDPPVQAIEEAAWKKHKLPKTLEEAMQMNRASVLLLSVPESDTEYGTGNDMTSMKAEDQNEQDSLLDCSITSIHIAEGRQRPKQRMQLPEQDLAFHDEKELGRNAIHDGSPTNDRTTDSKATSPQFGSISFYLAAQAVTSEVNVVFEKPFIDTQYAITANASVPGVTVSVTQRQRYSGVLTVERRQSGQICEGWILWIAMGTS

SEQ ID NO: 2962 - protein, 261 aa, Paenibacillus sp.
MNHRTNHNPKDKKIARRNHSNTVPSPRVNKEKTVSPAGAGSHRPTQRGTASIPVPVEKNTSLQAVEEAAWKKHKLPKTLEEAMQMNRASVLLLSVPDSDTECGTEHDIASMKTEGQTEQDSLLDCSITSIHIAEGRQRPKQRMRLLEQENHLASQTEKELGRNAIHDGSVTDDGTTDSEVTSPQFGSTSFYLPAQEVTSKVNVVFEKPFIDTQYAITANASLPGITVSVTQRQRYSAVLTVERRQSGSTCEGWVHWIAMGH

SEQ ID NO: 2963 - protein, 588 aa, Paenibacillus sp.
MKKLLSCLISLGMLVYILPTTIVSANNDGVTNLALDSTPSAQSDIISDAIYKITAQHSGKNLEVEGGSKDDGANVQQWTDNGKEQQKWRVVDVGDGYYKLISQSSGKALDVAGGNTHDGANVQQWTDNGNAQQKWKIIDAGGGYYKLISQSSGKALDVVGGNTHDGANVQQWADNGSAQQRWRFTQIDTTADTTPPTSPTNLQSSSKTSTSVTLTWTTSKDNVGVTGYVIYNGTDLVGTSTTTNYTVTGLTANTSYNFTVKAKDAAGNVSEPSSVLKVTTSSDSSQNTGFYVKGTTLYDGKGNPFVMRGINHAYTWYKGQESVAIPAIAKTGANTIRIVLSDGQQWTKDDLSALQSLITLSEQNKLVVILEVHDGTGSDNAAVLNKIADYWIEMKSALIGKENTVILNIANEWFGTWDGNGWAQGYKSVIPKLRNAGIKNTIMVDAAGWGQYPKSIFDYGTQVFDADPLKNTMFSIHMYEYAGGNAETVKSNIDNVLNKNLAVIIGEFGIKHTNGDVDEATIMSYAQQKGVGYLGWSWKGNGSGLEYLDMSNDWGGSSYTEQGRAIIEGPNGIRATSKLSTVYSSGKQ

SEQ ID NO: 2964 - protein, 588 aa, Paenibacillus sp.
MKKLLSCLISLSMLVYILPTMIVSANNDGVTNLALDSTPSAQSDIISDAVYKITAQHSGKSLEVEGGSKDDGANVQQWTDNGKEQQKWRVVDVGGGYYKLISQSSGKALDVAGGNTHDGANVQQWTDNGNAQQKWKIIDVGGGYYKLISQSSGKALDVVGGYTHDGANVQQWADNGSAQQRWRFTQIDTTTDTTPPTAPTNLQSSSKTSTSVTLTWTTSIDNVGVTGYVIYNGTDLVGTSTTTSYIVTGLTANTSYNFTVKAKDAAGNISEPSNVLKVTTSSDSSQNTGFYVKGTTLYDGNGNPFVMRGINHAYTWYKGQESVAIPAIAKTGANTIRIVLSDGQQWTKDDLSALQNLITLSEQNKLVVILEVHDGTGNDNAAVLNKIADYWIEMKSALIGKENTVILNIANEWFGTWDGNGWAQGYKSVIPKLRNAGIKNTIMVDAAGWGQYPKSIFDYGTQVFDADPLKNTMFSIHMYEYAGGNAETVKSNIDNVLNKNLALIIGEFGIKHTNGDVDEATIMSYAQQKGVGYLGWSWKGNGSGLEYLDMSNDWAGSSYTEQGHAIIEGPNGIRATSKLSTIYSNGKQ

SEQ ID NO: 2965 - protein, 579 aa, Paenibacillus sp.
MKKILTSLIFLGMLVDMLSVITVSAITNTTGSANSEITSGAVYKLTAQHSGKNLDVEGGRTTDGAKVQQWTDNGNAQQKWKVIDVGSGYYKLIVQSSGKVLTVAEGSTADGDSVQQWTDNGSSNQKWKIIDVGGGYFKLIAQSSGKALDVVGGYTNDGAIVQQWTDNGNAQQKWKFTRIDTAADTTPPTAPTNLQNPSKTSTSVNLTWTASTDNVGVTGYDIYNGTALAGSSTTTSYTVTGLSAHTSYSFTIKARDAAGNVSPASKILNVTTDPASTHTGFYIKGTTLYDANGNPFVMRGINHAYTWYKGQESVAIPAIAKTGANTIRIVLSDGQKWTKDNLSAIQNLITLSEQNKLVVVLEVHDGTGSDSATVLDNIANYWIEMKSALIGKEKTVILNIANEWFGTWDGTGWAQGYKSVIPKLRNAGIKNTIMVDGAGWGQYPQSIFDYGTEVFNADPLKNTMFSIHMYEYAGGNAATVKSNIDNVLNKNLALVIGEFGIKHTNGDVDEATIMSYAQQKGVGYLGWSWKGNGAGLEYLDMSTDWQGSSYTEQGRAIIEGPNGIKATSKLSTVYSGTTQ

SEQ ID NO: 2966 - protein, 265 aa, Paenibacillus sp.
MKRIFTLWLCVAVIGMLTVTAEPAWATQTVGGQPYHFGFKKSKGGELPSIAQEGFMQLIERQGGIFLGDTTKKELFLTFDNGYENGYTPKVLDVLKAKKVPAAFFVTGHFVKDQPDLMRRMASEGHIIGNHSWSHPDMSTISSTEIRSELDRVRNASAELTGQKEMKYVRPPRGIFSEKALASCREAGYTSVFWSVAYKDWDTNIHQGTDYAYRQVIGQLHPGAVILLHSVSKDNAEALGSIIDEARKQGYEFKSLDDLKVKHYH

SEQ ID NO: 2967 - protein, 265 aa, Paenibacillus sp.
MKRIFTLWLCIAVMGMLTVTAEPAWATQTVDGQPYHFGFKKSKGGELPSIAQEGFMQLIERQGGIFLGDTTKKELFLTFDNGYENGYTPKVLDVLKAKKVPAAFFVTGHFVKDQPDLMRRMASEGHIIGNHSWSHPDMSTISSTEIRSELDRVRNASAELTGQKDMKYVRPPRGIFSEKALASCREAGYTSVFWSVAYKDWDTNIQQGTDYAYRQVIGQLHPGAVILLHSVSKDNAEALGSIIDEARKQGYEFKSLDELKVKHYH

SEQ ID NO: 2968 - protein, 265 aa, Paenibacillus sp.
MKRIFTLWLCVAVMGMLAVTAEPAWATQTVDGQPYHFGFKKSKGGELPSIAQEGFMHLIERQGGIFLGDTTKKELFLTFDNGYENGYTPKVLDVLKAKKVPAAFFVTGHFVKDQPALMRRMASEGHIIGNHSWSHPDMSTISSAEIRSELDRVRNASAELTGQKEMKYVRPPRGIFSEKALASCREAGYTSVFWSVAYKDWDTNIQQGTDYAYRQVMRQLHPGAVILLHSVSKDNAEALASIIDEARKQGYEFKSLDDLKVKHYH

SEQ ID NO: 2969 - protein, 265 aa, Paenibacillus sp.
MKRIFTLWLCIAVMGMLAVTAEPAWATQTVDGQPYHFGFKKSKGGELPSIAQEGFMHLIERQGGIFLGDTTKKELFLTFDNGYENGYTPKVLDVLKAKKVPAAFFVTGHFVKDQPALMRRMASEGHIIGNHSWSHPDMSTISSAEIRSELDRVRNASAELTGQKEMKYVRPPRGIFSEKALASCREAGYTSVFWSVAYKDWDTNIQQGTDYAYRQVMGQLHPGAVILLHSVSKDNTEALASIIDEARKQGYEFKSLDDLKVKHYH

SEQ ID NO: 2970 - protein, 265 aa, Paenibacillus sp.
MKRIFTLWLCVAVIGMLAVTGESTQAAQTVDGQPYHFGFKKSKGGELPSIAQEGFMHLIERQGGIFLGDTTKKELFLTFDNGYENGYTPKVLDVLKAKKVPAAFFVTGHFVKDQPALMRRMASEGHIIGNHSWSHPDMSTISSAEIRSELDRVRNASAELTGQKEMKYVRPPRGIFSEKALASCREAGYTSVFWSVAYKDWDTNIQQGADYAYQQVIRQLHPGAVILLHSVSKDNTEALGSIIDEARKQGYEFKSLDDLKVKHYH

SEQ ID NO: 2971 - protein, 265 aa, Paenibacillus sp.
MKRILTLWLCIAMMGMSTVMGESASATQAVDGQPYHFGFKKSKGGELPSIAQEGFMHLIERQGGIFLGDTTKKELFLTFDNGYENGYTPKVLDVLKAKKVPAAFFVTGHFVKDQPDLMRRMASEGHIIGNHSWSHPDMSTISSAEIRSELDRVRTASAELTGQKEMKYVRPPRGIFNEKALASCREAGYTSVFWSVAYKDWDTNIQQGTDYAYRQVMQQLHPGAVILLHSVSKDNAEALGSIIDEARKQGYEFKSLDDLKVKHYH

SEQ ID NO: 2972 - protein, 265 aa, Paenibacillus sp.
MKRILTLWLCIAMMGMSTVMGESASATQAVDGQPYHFGFKKSKGGELPSIAQEGFMHLIERQGGIFLGDTTKKELFLTFDNGYENGYTPKVLDVLKAKKVPAAFFVTGHFVKDQPDLMRRMASEGHIIGNHSWSHPDMSTISSAEIRSELDRVRTASAELTGQKEMKYVRPPRGIFNEKALASCREAGYTSVFWSVAYKDWDTNIQRGTDYAYRQVMQQLHPGAVILLHSVSKDNAEALGSIIDEARKQGYEFKSLDDLKVKHYH

SEQ ID NO: 2973 - protein, 265 aa, Paenibacillus sp.
MKQIFTLWLCIALMGMSTVMGESASATQAVDGQPYHFGFKKSKGGELPSIAQEGFMHLIERQGGIFLGDTTKKELFLTFDNGYENGYTPKVLDVLKAKKVPAAFFVTGHFVKDQPDLMRRMASEGHIIGNHSWSHPDMSTISSAEIRSELDRVRTASAELTGQKEMKYVRPPRGIFNEKALASCGEAGYTSVFWSVAYKDWDTNIQRGTDYAYRQVMQQLHPGAVILLHSVSKDNAEALGSIIDEARKQGYEFKSLDDLKVKHYH

SEQ ID NO: 2974 - protein, 265 aa, Paenibacillus sp.
MKRMFALWLCTAVVGMLVVTGQPALATQAVDGQPYHFGFKKSKGGELPSIAQEGFMHLIERQGGIFLGDTTKKELYLTFDNGYENGFTPRVLDVLKAKKVPAAFFVTGHFVKDQPALMRRMASEGHIIGNHSWSHPDMSTISSAQIRSELDKVRSASAELTGQKEMKYVRPPRGIFSEKALASCREAGYTSVFWSVAYKDWDTNIQQGADYAYRQVIKQLHPGAVILLHSVSKDNAEALGSIIDEARKQGYEFKSLDDLKVKHYH

SEQ ID NO: 2975 - protein, 265 aa, Paenibacillus sp.
MKRILALWLCVAVMGMLAVTGKPLLAAQAVDGQPYHFGFKKSKGGELPSIAQEGFMHLIERQGGIFLGDTTKKELFLTFDNGYENGYTPKVLDVLKAKKVPAAFFVTGHFVKDQPALMRRMASEGHIIGNHSWSHPDMSTISSADIRSELDRVRNASTELTGQKEMKYVRPPRGIFSEKALATCREAGYTSVFWSVAYKDWDTNIQQGADYAYQQVMRQLHPGAVILLHSVSKDNAEALGSIIDDARKQGYEFKSLNDLKVKHYH

SEQ ID NO: 2976 - protein, 102 aa, Paenibacillus sp.
MPNQGGSSFTNKGFKASTGNQFKAEFAQDNTVGVVSQKVKQSEQNKIQDNFQTPNEKYDEEFATDQGGTGAVAQKVQNSSRNKIQNNAQTPNEKFDENFNTK

SEQ ID NO: 2977 - protein, 102 aa, Paenibacillus sp.
MPNQGGSSFTNKGFNASTGNQFKAEFAQDNTVGVVSQKVKQSEQNKIQDNFQTPNEKYDEEFATDQGGTGAVAQKVQNSSRNKIQNNAQTPNEKFDENFNTK

SEQ ID NO: 2978 - protein, 102 aa, Paenibacillus sp.
MPNQGGSSFTNKGFKASAGNQFKAEFAQDNTVGVVSQKVKQSEQNKIQDNFQTPNEKYDEEFATEQGGTGAVAQKVQNSSRNKIQNNAQTPNEKFDENFNTK

SEQ ID NO: 2979 - protein, 102 aa, Paenibacillus sp.
MPNQGGSSFTNKGFKASAGNQFKAEFAQDNTVGVVSQKVKQSEQNKIQDNFQTPNEKYDEEFATEQGGTGAVAQKVQNSSRNKVQNNAQTPNEKFDENFNTK

SEQ ID NO: 2980 - protein, 102 aa, Paenibacillus sp.
MPNQGGSSFTNKGFKANTGNQFKAEFAQDDTVGVVSQKVKQSEQNKIQDNFQTPNEKYDEEFATDQGGTSAVAQKVQNSSRSKIQSNAQTPNEKFDENFNTK

SEQ ID NO: 2981 - protein, 102 aa, Paenibacillus sp.
MPNQGGSSFMNKGFKANTGNQFKAEFAQDDTVGVVSQKVKQSEQNKIQDNFQTPNEKYDEEFATDQGGTSAVAQKVQNSSRSKIQSNAQTPNEKFDENFNTK

SEQ ID NO: 2982 - protein, 102 aa, Paenibacillus sp.
MPNQGGSSFMNKGFKANTGNQLKAEFAQDDTVGVVSQKVKQSEQNKIQDNFQTPNEKYDEEFATDQGGTSAVAQKVQNSSRSKIQSNAQTPNEKFDENFNTK

SEQ ID NO: 2983 - protein, 104 aa, Paenibacillus sp.
MPNQNQGGSSFTNKGFKANVGNQFKAEFAQDNSVGVVSQKVKQSEQNKIQDNFQTPNEKYDEEFATDQGGTSVVAQKVQNSSRSKIQSNAQTPNQKFDENFNTK

SEQ ID NO: 2984 - protein, 93 aa, Paenibacillus sp.
MNKGFKASTGNQFKAEFAQDNTVGVVSQKVKQSEQNKIQDNFQTPNEKYDEEFATDQGGTGAVAQKVQNSSRSKIQNNAQTPNEKFDENFNTK

SEQ ID NO: 2985 - protein, 102 aa, Paenibacillus sp.
MPNQGGSSNMNQGAKASAGNQFKAEFAQDNSVGVVSQKVKKSEQNKIQDNYQTPNEKYSEEFATDVAGTSAVAQKVQNASRNKIQSNAQTPNQKFDENFNTK

SEQ ID NO: 2986 - protein, 102 aa, Paenibacillus sp.
MPNQGGSSNMNQGAKASAGNQFKAEFAQDNSVGVVSQKVKKSEQNKVQDNYQTPNEKYSEEFATDVAGTSAVAQKVQNASRNKIQSNAQTPNQKFDENFNTK

SEQ ID NO: 2987 - protein, 102 aa, Paenibacillus sp.
MPNQGGNSYMNQGNKANAGSQYKAEFGQDNSVGVVSQKVKKSEQNKIQDNFQTPNEKYDEEFAADQGGTNSVAQKVQNSSRSKVQNNAQTPNEKFDENFNTK

SEQ ID NO: 2988 - protein, 102 aa, Paenibacillus sp.
MANQGGNSYMNQGNKANAGSQYKAEFAQDNSVGVVSQKVKKSEQNKIQDNYQTPNEKYSEEFAADQGGTSSVAQKVQNSSRSKVQNNAQTPNEKFDENFNTK

SEQ ID NO: 2989 - protein, 720 aa, Paenibacillus sp.
MKQLKTKQVLRKSMKYAFALSLVASSFLPGAGFTDKIHAESHVDNPYQGATKYISPDYAASVDTSIAKITDANLKAKMQTVKTFPTAVWLDRIAAINGGGGKLGLEAHLDQVLAQKKGSTPITAEFIVYDLPGRDCHALASNGELPLTQAGLETYKKDYIDKIAAIFSNPKYKDIRIVTIIEPDSLPNLVTNLDDPKCAQAKSTGIYEAGVKYTMNKLNEIPNVYKYVDIGHSGWLGWDNNRSATVSLFTTIFKDTSKGLASVDGFITNTANTSPLTEPNLPDPNLNIGGQPIKSSKYYEWNPNFDESDFAEALHRDFVSAGWPSSLGMLIDTGRNGWGGPNRPTSAVGNDINSYVNSGRVDKRSHRGNWCNNSGAGMGTPPQTAPAGHIDAYVWAKPPGDSDGSSSLIPNDEGKGFDRMCDPTYTTKDGTLTDALPNAPISGAWFHDQFVMLVQNAYPAIVPSTGGVDPAPTAPAVPSGLKAVVGNAQVTLTWNASTGADSYTVKRATSEAGPFTAVAPLVTEREYTDKGLTNGTTYFYVVSATNAKGTSKDSAAVSAEPKGTPTDPTDPTDPTEPAGDLVVMYRAGDTDPANNAVKPFFNLKNKGTTPVKLSELKIRYYFTKDGSQELQSAVDYAQVGNDNVLRTIKDNYIEIGFSPAAGTLAAGAQTGDIQIRMNNSDWSNLDESNDYSFDPTKTSYAEWNKATLFHNDKLVWGIEP

SEQ ID NO: 2990 - protein, 707 aa, Paenibacillus sp.
MKYAFALSLVASSFLPGAGFTDKIHAESHVDNPYQGATKYISPDYAASVDTSIAKITDANLKAKMQTVKTFPTAVWLDRIAAINGGGGKLGLEAHLDQVLAQKKGSTPITAEFIVYDLPGRDCHALASNGELPLTQAGLETYKKDYIDKIASIFANPKYKDIRIVTIIEPDSLPNLVTNLDDPKCAQAKSTGIYEASVKYTMNKLNEIPNVYKYVDIGHSGWLGWDNNRSATVSLFTTIFKDTSKGLASVDGFITNTANTSPLTEPNLPDPNLNIGGQPIKSSKYYEWNPNFDESDFAEALHRDFVSAGWPSSLGMLIDTGRNGWGGPNRPTSAVGNDINSYVNSGRVDKRSHRGNWCNNSGAGMGTPPQTAPAGHIDAYVWAKPPGDSDGSSSLIPNDEGKGFDRMCDPTYTTKDGTLTDALPNAPISGAWFHDQFVMLVQNAYPAIVPSTGGVDPAPTAPAVPSGLKAVVGNAQVTLTWNASTGADSYTVKRATSEAGPFTAVAPLVTEREYTDKGLTNGTTYFYVVSATNAKGTSKDSAAVSAEPKGTPTDPTDPTDPTEPAGDLVVMYRAGDTDPANNAVKPFFNLKNKGTTPVKLSELKIRYYFTKDGSQELQSAVDYAQVGNDNVLRTFTDNYIEIGFSPAAGTLAAGAQTGDIQIRMNNSDWSNLDESNDYSFDPTKTSYAEWNKATLFHNDKLVWGIEP

SEQ ID NO: 2991 - protein, 717 aa, Paenibacillus sp.
MKQLKTKQVLRKSMKYAFALSLVASSFLPGAGFTDKIHAESHVDNPYQGATKYVSPDYAASVDTSIAKITEANLKAKMQTVKTFPTAVWLDRIAAINGGGGKLGLEAHLDQVLAQKKGSTPITAEFIVYDLPGRDCHALASNGELPLTQAGLETYKKDYVDKIASIFSNPKYKDIRIVAIIEPDSLPNLVTNLDDPKCAQAKSTGIYEAGVKYTMNKLNEIPNVYKYVDIGHSGWLGWDNNRAATVSLFTTIFKDTSKGLSSVDGFITNTANTSPLTEPNLPDPNLNVGGQPIKSSKYYEWNPNFDESDFAESLHRDFVSAGWPSSLGMLIDTGRNGWGGPNRPTSAVGNDINSYVNSGRVDKRSHRGNWCNNSGAGMGTPPQTAPAGHIDAYVWAKPPGDSDGSSSLIPNDEGKGFDRMCDPTYTTKDGTLTDALPNAPISGAWFHDQFVMLVQNAYPAIVPSTGGVDPAPTAPAVPSGLKAVVGNAQVTLTWNASTGADSYTVKRATSEAGPFTAVAPLVTEREYTDKGLTNGTTYFYVVSATNAKGTSKDSATVSAEPKGTPTDPTDPTEPAGDLVVMYRAGDTDPANNAVKPFLNLKNKGTTPVKLSELKIRYYFTKDGSQELQSAVDYAQVGNDNVLRTITDNYIEIGFSAAAGSLAAGAQTGDIQIRMNNSDWSNLNESNDYSFDPTKTSYAEWNKVTLFHNDKLVWGIEP

SEQ ID NO: 2992 - protein, 714 aa, Paenibacillus sp.
MKTKQVLRKSMKYAFALSLVASSFLPGAGFTDKIHAESHVDNPYQGATKYVSPDYAASVDTSIAKITEANLKAKMQTVKTFPTAVWLDRIAAINGGGGKLGLEAHLDQVLAQKKGSTPITAEFIVYDLPGRDCHALASNGELPLTQAGLETYKKDYVDKIASIFSNPKYKDIRIVAIIEPDSLPNLVTNLDDPKCAQAKSTGIYEAGVKYTMNKLNEIPNVYKYVDIGHSGWLGWDNNRAATVSLFTTIFKDTSKGLSSVDGFITNTANTSPLTEPNLPDPNLNVGGQPIKSSKYYEWNPNFDESDFAESLHRDFVSAGWPSSLGMLIDTGRNGWGGPNRPTSAVGNDINSYVNSGRVDKRSHRGNWCNNSGAGMGTPPQTAPAGHIDAYVWAKPPGDSDGSSSLIPNDEGKGFDRMCDPTYTTKDGTLTDALPNAPISGAWFHDQFVMLVQNAYPAIVPSTGGVDPAPTAPAVPSGLKAVVGNAQVTLTWNASTGADSYTVKRATSEAGPFTAVAPLVTEREYTDKGLTNGTTYFYVVSATNAKGTSKDSATVSAEPKGTPTDPTDPTEPAGDLVVMYRAGDTDPANNAVKPFLNLKNKGTTPVKLSELKIRYYFTKDGSQELQSAVDYAQVGNDNVLRTITDNYIEIGFSAAAGSLAAGAQTGDIQIRMNNSDWSNLNESNDYSFDPTKTSYAEWNKVTLFHNDKLVWGIEP

SEQ ID NO: 2993 - protein, 714 aa, Paenibacillus sp.
MKTKQVLRKGMKYAFALSLVASSFLPGAGFTDKIHAESHVDNPYQGATKYVNPDYAASVDTSIAKVTDANLKAKMQTVKTFPTAVWLDRIAAINGGGGKLGLEAHLDQVLAQKKGNTPITAEFIVYDLPGRDCHALASNGELPLTQAGLETYKKDYIDKIASIFANPKYKDIRIVAIIEPDSLPNLVTNLDTPQCGQAKSTGIYEAGVKYTMNKLNEIPNVYKYVDIGHSGWLGWDNNRAATVSLFTTIFKDTSKGLASVDGFITNTANTSPLTEPNLPDPNLNIGGQPIKSSKFYEWNPNFDESDFAESLHRDFVNAGWPSSLGMLIDTGRNGWGGPNRPTSAVGNDINSYVNSGRVDKRSHRGNWCNSSGAGMGTPPQTAPAGHIDAYVWAKPPGDSDGSSSLIPNDEGKGFDRMCDPTYTTKDGTLTDALPNAPISGAWFHDQFVMLVQNAYPAIVPSSGGVDPAPTAPAVPSGLKATVGNAQVTLTWDASTGADSYTVKRATSEAGPFTAVAPLVTAREYTDKGLTNGTTYFYVVSATNAKGTSKDSATVSAEPKGTPTDPTDPTDPAGDLVVMYRAGDTDPANNAAKPFFNLKNKGTTPVKLSELKIRYYFTKDGSQELQSAVDWAQVGNDNVLRTIKDNYIEIGFSAAAGTLAAGAQTGDIQIRMNNSDWSNLNESNDYSFDPTKTSYAEWNKVTLFHNDKLVWGIEP

SEQ ID NO: 2994 - protein, 717 aa, Paenibacillus sp.
MKQLKTKQVLRKSMKYAFALSLVASSFLPGAGFTDKIHAESHVDNPYQGATKYVSPDYAASVDTSIAKITDANLKAKMQTVKTFPTAVWLDRIAAINGGGGRLGLEAHLDQVLAQKKGSTPITAEFIVYDLPGRDCKALASNGELPLTQAGLETYKKDYVDKIAAIFANPKYQDIRIVAIIEPDSLPNLVTNLDTPQCAQAKSTGIYEAGIKYTMNKLNEIPNVYKYVDIGHSGWLGWDNNRSATVSLFTTIFKDTSKGLSSVDGFISNTANTSPLTEPNLPNPDLNIGGQPIKSSKFYEWNPNFDELHFTESLYKDFVNAGWPSSLGMLIDTSRNGWGGPNRPTSAVGSDINSYVNSGRVDKRAHRGNWCNSSGAGMGTPPQTAPAGHIDAYVWAKPPGDSDGSSSLIPNDEGKGFDRMCDPTYTTKDGTLTDALPNAPISGAWFHDQFVMLVQNAYPAIVPSTGGVDPAPTAPAVPSGLKAVAGNAQVTLTWNASTGADSYTVKRATSEAGPFTAVAPLVTAREYTDKGLTNGTTYFYVVSATNAKGTSKDSATVSAEPKGTPTDPTDPTEPAGDLVVMYRAGDTDPANNAAKPFFNLKNKGTTPVKLSELKVRYYFTKDGSQELQSAVDWAQVGNDNVLRTIKDNYIEIGFSAAAGTLAAGAQTGDIQIRMNNSDWSNLNESNDYSFDPTKTSYAEWNKVTLFHNDKLVWGIEP

SEQ ID NO: 2995 - protein, 714 aa, Paenibacillus sp.
MKQLKTKQVLRKGMKYAFALSLVAGSFLPGAGFTDKIHAESHVDNPYQGATKYVSPDYAASVDTSIAKVTDSTLKAKMQTVKTFPTAVWLDRIAAINGGGGKLGLEAHLDQVLAQKKGNTPITAEFIVYDLPGRDCKALASNGELPLTQAGLETYKKDYVDKIAAIFANPKYQDIRIVAIIEPDSLPNLVTNLDTPQCGQAKSTGIYEAGIKYTMNKLNEIPNVYKYVDIGHSGWLGWDNNRSATVSLFTTIFKDTSKGLSSVDGFISNTANTSPLTEPNLPNPDLNIGGQPIKSSKFYEWNPNFDELHFTESLHKDFVNAGWPSSLGMLIDTSRNGWGGPNRPTAAVGSDINSYVNSGRVDKRSHRGNWCNSSGAGMGTPPQTAPASHVDAYVWAKPPGDSDGSSSLIPNDEGKGFDRYCDPTYTTKDGTLTDALPNAPISGAWFHDQFAMLVQNAYPAIVPSSGGVDPSPTAPAVPSGLKAVAGNAQVTLTWNASTGADSYTVKRATSEAGPFTAVAPLVTEKEYTDKGLTNGTTYFYVVSATNAKGTSKDSAAVSAEPKGTPTDPTEPAGDLVVMYRAGDTDPANNAIKPFFNLKNKGTTPVKLSELKIRYYFTKDGSQELQSAVDYAQVGNDNVLRTFTDNYIEIGFSPAAGTLAAGAQTGDIQIRINNSDWSNLDESNDYSFDPTKTSYTEWNKATLFHNDKLVWGIEP

SEQ ID NO: 2996 - protein, 707 aa, Paenibacillus sp.
MKYAFALSLVASSFLPGAGFTDKIHAESHVDNPYQGATKYVSPDYAASVDTSIAKITDANLKAKMQTVKTFPTAVWLDRIAAINGGGGKLGLEAHLDQVLAQKKGNTPITAEFIVYDLPGRDCKALASNGELPLTQAGLETYKKDYVDKIAAIFANPKYQDIRIVAIIEPDSLPNLVTNLDTPQCAQAKSTGIYEAGIKYTMNKLNEIPNVYKYVDIGHSGWLGWDNNRSATVSLFTTIFKDTSKGLSSVDGFISNTANTSPLTEPNLPNPDLNIGGQPIKSSKFYEWNPNFDELHFTESLHKDFVNAGWPSSLGMLIDTSRNGWGGPNRPTAAVGSDINSYVNSGRVDKRSHRGNWCNSSGAGMGTPPQTAPASHVDAYVWAKPPGDSDGSSSLIPNDEGKGFDRYCDPTYTTKDGTLTDALPNAPISGAWFHDQFAMLVQNAYPAIVPSSGGVDPSPTAPAVPSGLKAVAGNAQVTLTWNASTGADSYTVKRATSEAGPFTAVAPLVTEKEYTDKGLTNGTTYFYVVSATNAKGTSKDSATVSAEPKGTPTDPTDPTDPTEPAGDLVVMYRAGDTDPANNAAKPFFNLKNKGTTPVKLSELKVRYYFTKDGSQELQSAVDWAQVGNDNVLRTIKDNYIEIGFSAAAGTLAAGAQTGDIQIRMNNSDWSNLNESNDYSFDPTKTSYAEWNKVTLFHNDKLVWGIEP

SEQ ID NO: 2997 - protein, 742 aa, Paenibacillus sp.
MKTKQVLRKGMKYAFALSLVAGSFLPGTGLTGKINAESHVDNPYIGATKYISPDYAAFVDSSIAKVTDANLKAKMQTVKTFPTSVWLDRIAAIKGTPGNLGLEEHLDQVLAQKKGDTPITAEFIIYDLPGRDCHALASNGELPLTQAGLETYKKDYVDKIAEILANPKYKDIRIVTIIEPDSLPNLVTNMSDPKCAQAKSTGIYETGIQYTINKLNEIPNVYKYVDIGHSGWLGWDNNRSATVSLYTNVFRNTSKGLSSVDGFITNTANTTPLVEPNLPDSNLNINGQPIKSSKYYEWNPYFDELHFTEGLHRDFVNAGWPSSLGMLIDTGRNGWGGPNRPTKATGNDINSYVNSGRVDRRDHRGNWCNNSGAGMGTPPQTAPASHVDAYVWAKPPGASDGSSSLIPNDEGKGFDRMCDPTYTTSDGVLTGALPNAPISGAWFHDQFVMLVNNAYPAIKAADGSVDPAPTPTPTPTPEAPAVPADLQGKLGVKLTWAASTGAQSYTVKRATSEEGPFTTIASRVTGTEYTDTDLTNGTTYYYVISATNANGSSKDSAVVKVTVGSKATTPTNPTDPTPTPDPTPTPEPTPDPTPTPTEPAGDLAVLYRAGDTDPTNNAIKPFFNVKNNGTTPVKLSDLKIRYYFTKEGNQDMQSAVDWAQIGNDNVLRTFTDKYIEIGFSPAAGTLAAGAQTGEIQVRINKNDWSNHDESNDYSFDPTKTSYTEWNKVTLFQNDELVWGIEP

SEQ ID NO: 2998 - protein, 631 aa, Paenibacillus sp.
DRTPAINGGGGKLGLEAHLDQVLAQKKGNTPITAEFIVYDLPGRDCKALASNGELPLTQAGLETYKKDYIDKIATIFANPKYKDIRIVAIIEPDSLPNLVTNLNDPKCAEAKSTGIYEAGIKYTINKLNDIPNVYKYVDIGHSGWLGWDNNRTATVSLFTNVFRDTSKGLSSVDGFITNTANSSPLTEPNLPDPNLNIGGQPIKSSKYYEWNPNFDESDFAEALHRDFVSAGWPSSLGMLIDTGRNGWGGPNRPTAAVGSDINSYVNSGRVDKRSHRGNWCNNSGAGMGTPPQTAPASHVDAYVWAKPPGDSDGSSSLIPNDEGKGFDRYCDPTYTTKDGTLTDALPNAPISGAWFHDQFVMLVQNAYPAIVPSSGGGTTPTPSAPAVPAGLKATAGNAEVKLTWNASTGADSYTVKRATSEAGPFTTVAPLVTEKEYTDKGLTNGTTYFYVLSATNTTGTSKDSTAVSAEPKGTPIDPTDPTDPTEPAGDLVVMYRAGDTDPANNSAKPFLNLKNKGTTPVKLSELKVRYYFTKDGSQELQSAVDYAQVGNDNVLRTITDNYIEIGFNAAAGTLAAGAQTGDIQIRINNSDWSSLDESNDYSFDPTKTSYTEWNKVMLFHNDKQVWGIEP

SEQ ID NO: 2999 - protein, 751 aa, Paenibacillus sp.
MKQLKTKQVLRKGMKYAFALSLVAGSLLPTTGFTGKISAESHVDNPYIGATKYISPDYAAFVDSSIAKVTDAKLKAKMQTVKSFPTSVWLDRIAAINGTADNLGLEAHLDQVLAQKKGDTPITAEFIIYDLPGRDCHALASNGELPLTQAGLETYKKDYVDKIAEILANPKYKDIRIVTIIEPDSLPNLVTNMSDPKCAQAKSTGIYETGIQYTINKLNEIPNVYKYVDIGHSGWLGWDNNRSATVSLYTNVFRNTSKGLSSVDGFITNTANSTPLVEPNLTDSNLNINGQPIKSSKYYEWNPYFDELHFTEGLHRDFVNAGWPSTLGMLIDTGRNGWGGPNRPTKATGNDINSYVNSGRVDRRDHRGNWCNNSGAGMGTPPETAPASHVDAYVWAKPPGASDGSSSLIPNNEGKGFDRMCDPTYTTSDGVLTGALPNAPISGAWFHDQFVMLVNNAYPAIKAADGSVDPAPTPTPTPTPTPEAPAVPADLQGKLGVKVTWAASTGAQSYTVKRATSEAGPFTTVASRVTGTEYTDTDLTNGTTYYYVISATNANGSSKDSAVVKVTVGSKATTPTNPTDPTPTPDPTPTPEPTPTPTPDPTPTPTEPAGDLSVLYRAGDTDPTNNAIKPFFNVKNNGTTPVKLSDLKIRYYFTKEGNQDMQSAVDWAQIGNDNVLRTFTDKYIEIGFSPAAGTLAAGAQTGEIQVRINKNDWSNHDESNDYSFDPTKSSYTEWNKVTLFQNDQLVWGIEP

SEQ ID NO: 3000 - protein, 344 aa, Paenibacillus sp.
MKQRRQTWTRIVFLIISCLLLFVISGFVYEWIASKKDKSQYPPPGELVDAGGYRLHIRKLGNGSPTILLESGSGESSLSWRDIPEKLSSFATVVSYDRAGYAWSEEANTPRTGENIVRELHTALKNADIRPPYILVGHSLGGMYSRLYAQTYRDEVAGLVLVDARPENDARRTNKIYAKERPKANPSPLISILLEKSGAFRLFPNFMLTGRVEYQDRKSFVNIVASSKYFRSVAEEGDLASTTEDAIRGQHLGNLPVRVIARGIQQDLAQFGISKRGNDQIEQSWQIGQREMLNISTNSKLIVAKKSEHMIIHDQPELVIQVIRELITNTSHFQSTTSKAYTDD

SEQ ID NO: 3001 - protein, 344 aa, Paenibacillus sp.
MKQRKRTWTRIVFLIISCLLLFVISGFVYEWIASKKDKSQYPPPGELVDAGGYRLHIRKLGNGSPTILLESGSGESSLSWRDIPEKLSSFATVVSYDRAGYAWSEEAATPRTGENIVRELHLALKNADIQAPYILVGHSLGGMYSRLYAQTYKDEVAGLVLVDARPENDARRTNEIYAKERPKVNPSPLISILLEKSGAFRLFPNFMLTGRVEYQDRNSFVNIVASSKYFRSVAEEGDLASTTEDAIRGQHLGNLPVRVIARGVQQDLTQFGISKRGNDQIEQSWQMGQREMLNISTNSKFIVAKKSEHMIIHDQPELVIQVIRELITDTSHFQSTMSKAYTDD

SEQ ID NO: 3002 - protein, 344 aa, Paenibacillus sp.
MKQRRRTWTRIVFLIISCLLLFVISGFVYEWIASKKNKSQYPPPGEMVDAGGYQLHIRKLGSGSPTILLESGSGESSLSWRDIPEKLSSFATVVSYDRAGYAWSEEAATPRTGENIVRELHVALKNADIQAPYILVGHSLGGMYSRLYAQTYKDEVAGLVLVDARPENDARRTNEIYAKERPKVNPSPLISILLEKSGAFRLFPNFMLTGRVEYQDRKSFVNIVASSKYFRSVAEEGDLANTTEDAIRGQHLGNLPVRVIARGIQQDLTQFGISKRGNDQIEQSWQMGQREMLNISTNSKFIVAKKSEHMIIHDQPELVIQVIRELITDTRHFQSTMSKANTDD

SEQ ID NO: 3003 - protein, 344 aa, Paenibacillus sp.
MKQRRRTWTRIVTLIISCLLLVVISGFVYEWIASKQDKLQYPPLGEMVDAGEYRLHIHKLGSGSPTILLESGSGESSLSWRDIPEKLSSFATVVSYDRAGYAWSEEAATPRTGENIIRELHVALKNANIQAPYILVGHSLGGMYSRLYAQTYRDEVAGLVLVDARPENDARRTNEIYAKERPKGNPSPLLSILLEKSGAFRLFPNYMLTGRVEYQDRKSFVNIVASPKYFRSVAEEGDLASTTEDAIRGQHLGNLPVRVIARGIQQDLTQFGISKRGNDQIEQSWQIGQREMLNISTNSKFIVAKKSEHMIIHDQPELVIQVICELITDTSHFQSTMSKAYTDD

SEQ ID NO: 3004 - protein, 344 aa, Paenibacillus sp.
MKQRRRTWTRVVFGVISCLLLVVISGFVYEWIASKHDKSQHPPLGRMVDAGGYRLHIHKIGAGSPTIVLESGSGESSLSWRDIPEKLSSFATVVSYDRAGYAWSEEANTPRTGENIVRELHTALKNADIQPPYIFVGHSLGGMYSRLYAQTYRKEVAGLVLVDARPENDARRTNKIYAKERPKGNPSPLISILLEKAGAFRLFPNFMLNGRVEYRDRKSFVNIVASPKYFRSVAEEGDLASTTEDAIRGQHLGNLPVRVIARGIQQDLTQFGISKRGNDQIEQSWQIGQREMLNISTNSKFIVAKKSEHMIIHDQPELVIQVIRELISNIHYSRSTVAKTNTDH

SEQ ID NO: 3005 - protein, 344 aa, Paenibacillus sp.
MKQRRQTWTKIMFWVISCLLLVVISGFVYEWIASKQDKSQYPPPGEMVDAGSHQLHIRKLGSGSPTILLESGSGESSLSWRDIPEKLSTFATVVSYDRAGYAWSEEAATPRTGENIVRELHVALKNADIQAPYILVGHSLGGMYSRLYAQTYDDEVAGMILVDARPENDARRTQEIYAKERPKVNPSPLISILLKRSGAFRLFPNFMLTGRVEHQDRKSFVNIVASPKYFRSVAEEGDLANTTENAIRGQHLGNLPVRVIARGIQQDLTQFGISKNGNDQIEQSWQMGQREMLNISTNSKFIVAKKSDHMIIHDQPELVIQVIRELISNTSHPRSTFAKSKTDD

SEQ ID NO: 3006 - protein, 344 aa, Paenibacillus sp.
MKQRRLTWTKVVFWVISCLLLVVISGFVYEWIASKHDKSQHPPLGRMVDAGGYRLHIHKMGAGSPTIVLESGSGESSLSWRDIPEKLSSFATVVSYDRAGYAWSEEANTPRTGENIVRELHTALKNADIQAPYILVGHSLGGMYSRLYAQTYRDEVAGLVLVDARPENDARRTNKIYAKERPKVNPSPLISILLERSGAFRLFPNLMLNGRVEYRDRKSFVNIVASPKYFRSVAEEGDLASTTEDAIRDQHLGNLSVRVIARGIQQNLTQFGISKRGNDQIEQSWQIGQREMLHISNNSKLIVAKKSEHMIIHDQPELVIQVIRDLISNIHYSRSTIAKTNTDH

SEQ ID NO: 3007 - protein, 533 aa, Paenibacillus sp.
MTRNKRLRRLSTAMLTVPMLTMFASGAMAEQELNRHKPPVSTGSGVFYEIYINSFYDSNGDGHGDLKGITQKLDYLNDGKPHSGKDLQVSGLWLMPLNPSPSYHKYDVTDYYQLDPQYGSLNDFRTLMKEADRKGVKVIMDLVINHSSSEHPWFKEASANPQSKYHNYYVWADENTDLEEKGSWGQQVWHKNPNGEGYFYGTFWSGMPDLNFDNPEVRKEMIKVGKYWLQQGADGFRLDAAMHIFRGQTKDGADKNIAWWNEFRSEMEKVNPNVYLAGEVWDKPETIAPYFGPLHSLFNFDLGGTILNSVKNGRDQGIATFAEKTLQLYKSYNKAALDAPFLSNHDQTRVMSELGGDVRKAKLAASILLTLPGQPFLYYGEEIGMKGEKPDEYLREPMRWYKGDGPGQTTWEKPKYNTGEVSVEAQLRDDDSLLESYRTLIRLREEHEALRSDSLQPIQAGSASVTAFKRTSGKETMYVYHNLSGESVTLQIKDFDKGKWKVIFSTSKDVKVKKGTVTIPAYSSLITEEDRKS

SEQ ID NO: 3008 - protein, 533 aa, Paenibacillus sp.
MTRNKRLRRLSTAMLTVPMLTMFASGAMAEQELNRHKPPVSTGSGVFYEIYINSFYDSNGDGHGDLKGITQKLDYLNDGKPHSGKDLQVSGLWLMPLNPSPSYHKYDVTDYYQVDPQYGSLNDFRTLMKEADRKGVKVIMDLVINHSSSEHPWFKEASANPQSKYHNYYVWADENTDLEEKGSWGQQVWHKNPNGEGYFYGTFWSGMPDLNFDNPEVRKEMIKVGKYWLQQGADGFRLDAAMHIFRGQTKDGADKNIAWWNEFRSEMEKVNPNVYLAGEVWDKPETIAPYYGPLHSLFNFDLGGTILNSVKNGRDQGIVTLAEKTLQLYKSYNKAALDAPFLSNHDQTRVMSELGGDVRKAKLAASILLTLPGQPFLYYGEEIGMKGEKPDEYLREPMRWYKGDGPGQTTWEKPKYNTGEVSVEAQLRDDDSLLESYRTLIRVRDEHEALRSDSLQPIQAGSASVTAFKRTSGKETMYVYHNLSGEPVTLQIKDFDKGKWKVVFSTSKDVKVKKGTVTIPAYSSLITEEDRKS

SEQ ID NO: 3009 - protein, 533 aa, Paenibacillus sp.
MTRNKRLRRLSTAMLTVPMLTMFASGAMAEQEMNGHKPPVSTGSGVFYEIYINSFYDSNGDGHGDLKGITQKLDYLNDGKPHSGKDLQVSGLWLMPLNPSPSYHKYDVTDYYQVDPQYGSLNDFRTLMKEADRKGVKVIMDLVINHSSSEHPWFKEASANPQSKYHDYYVWADENTDLEEKGSWGQQVWHKNPNGEGYFYSTFWSGMPDLNFDNPEVRKEMIKVGKYWLQQGADGFRLDAAMHIFRGQTKDGADKNIAWWNEFRSEMEKVNPNVYLAGEVWDKPETIAPYYGPLHSLFNFDLGGTILNSVKNGRDQGIAAFAEKTLQLYKSYNKAALDAPFLSNHDQTRVISEVGGDVRKAKLAASILLTLPGQPFLYYGEEIGMKGEKPDEYLREPMRWYKGDGPGQTTWEKPKYNTGEVSVEAQLRDDDSLLESYRTLIRLREEHEALRSDSLQPIQAGSASVTAFKRTSGKETLYVYHNLSGEPVTLQMKDFDKGKWKVVFSTSKNVKVKKGTVTIPAYSSLITEEDRKS

SEQ ID NO: 3010 - protein, 533 aa, Paenibacillus sp.
MTRNKRLRRLSTAMLTVPMLTMFASGAMAEQEMNGHKPPVSSGSGVFYEIYINSFYDSNGDGHGDLKGITQKLDYLNDGKPHSGKDLQVSGLWLMPLNPSPSYHKYDVTDYYQVDPQYGSLNDFRTLMKEADRKGVKVIMDLVINHSSSEHPWFKEASANPQSKYHDYYVWADENTDLEEKGSWGQQVWHKNPNGEGYFYGTFWSGMPDLNFDNPEVRKEMIKVGKYWLQQGADGFRLDAAMHIFRGQTKDGADKNIAWWNEFRSEMEKVNPNVYLAGEVWDKPETIAPYYGPLHSLFNFDLGGTILNSVKNGRDQGIAAFAEKTLQLYKSYNKAALDAPFLSNHDQTRVMSELGGDVRKAKLAASILLTLPGQPFLYYGEEIGMKGEKPDEYLREPMRWYKGDGPGQTTWEKPKYNTGEVSVEAQLKNDDSLLESYRTLIRLREEHGALRSDSLQPIQAGSASVTAFKRTSGKETLYVYHNLSGEPVTLQMKDFEKGKWKVVFSTSKNVKVKKGTVTIPAYSSLITEEDRKS

SEQ ID NO: 3011 - protein, 533 aa, Paenibacillus sp.
MTRNKRLRRLSTAMLTVPMLTMFASGAMAEQELNGHKPPVSTGSGVFYEIYINSFYDSNGDGHGDLKGITQKLDYLNDGKSHSGKDLQVSGLWLMPLNPSPSYHKYDVTDYYQVDPQYGSLNDFRTLMKEAHRKGVKVIMDLIINHSSSDHPWFKEASANPQSKYHDYYVWADENTDLEEKGSWGQQIWHKNPNGEGYFYGTFWSGMPDLNFDNPEVRKEMIKVGKYWLQQGADGFRLDAAMHIFRGQTKDGADKNIAWWNEFRSEMEKVNPNVYLAGEVWDKPETIAPYYGPLHSLFNFDLGGTILNSVKNGRDQGIATFAEKTLQLYKSYNKAALDAPFLSNHDQTRVMSELGGDVRKAKLAASILLTLPGQPFLYYGEEIGMKGEKPDEYLREPMRWYKGDGPGQTTWEKPKYNTGEVSVEAQLRDDDSLLESYRTLIRLREEHDALRSDSLQPIQAGSASVTAFKRTSDKESLYVYHNLSGEPVTLQMKDFDKGKWKVVFSTSKDVKVKKGTITIPAYSSLITKEDRKS

SEQ ID NO: 3012 - protein, 533 aa, Paenibacillus sp.
MTRNKRLRRLSTAMLTVPMLTMFASSAMAEQESNGHKPPVSTGSGVFYEIYINSFYDSNGDGHGDLKGITQKLDYLNDGKPHSGRDLQVSGLWLMPLNPSPSYHKYDATDYYQVDPQYGSLNDFRTLMKAADRKGVKVIMDLVINHSSSEHPWFKEASANPQSKFHDYYVWADENTDLEEKGSWGQQVWHKNPNGEGYFYSTFWSGMPDLNFDNPEVRKEMIKVGKYWLQQGADGFRLDAAMHIFRGQTKDGADKNIAWWSEFRSEMEKVNPNVYLAGEVWDKPETIAPYYGQLHSLFNFDLGGTILKSVKNGRDQGIAAFAEKTLQLYKSYNKAALDAPFLSNHDQTRVMSELGGDVRKAKLAASILLTLPGQPFLYYGEEIGMKGEKPDEFLREPMRWYKGEGPGQTTWEKPKYNKGEVSVEAQLRDDDSLLESYRTLIRLREKHEALRSDSLQPIQAGSASVTAFKRTSGKEALYVYHNLSGEPVTLQMKDSDKGKWKVVFSTSKDVKVKKGTVKIPAYSSLITEEDRKS

SEQ ID NO: 3013 - protein, 533 aa, Paenibacillus sp.
MTRNKRLRKLSTAMLTVPMLMMFASGAMAEQEMNGHKPPVSTGSGVFYEIYINSFYDSNGDGHGDLKGITQKLDYLNDGKPSSGQDLQISGLWLMPLNPSPSYHKYDVTDYYQVDPQYGNLNDFRTLMKEAHRKGIKVIMDLVINHSSSDHPWFKEASANPQSKYRDYYVWADKNTDLDEKGSWGQQVWHKNPNGEGYFYGTFWSGMPDLNFDNPEVREEMIKVGKYWLQQGADGFRLDAAMHIFKGQTKEGADKNIAWWNEFRSEMEKVNPNVYLAGEVWDKPETIAPYFGPLHSLFNFDLGGTMLNSIKNGRDQGIATFAEKTLKLYKSYNKATLDAPFLSNHDQTRVMSELGGDVRKAKLAASILLTLPGQPFLYYGEEIGMKGEKPDEYLREPMRWYKGDGPGQTTWEKPKYNTGEVSVEAQLRNDDSLLESYRKLIRLREEHEALRSDSLETIQTGTASVTAYKRTSGKETLYVFHNLSGESVTLQIKDSDKGKWKVVFSTSKDVKVKKGTVMIPAYSSLITKEDRKS

SEQ ID NO: 3014 - protein, 533 aa, Paenibacillus sp.
MTRNKRLRRLSTAMLTVPMLMMFASGAMAEQEMNGHKPPVSTGSGVFYEIYINSFYDSNGDGHGDLKGITQKLDYLNDGKLRSGKDLQVSGLWLMPLNPSPSYHKYDVTDYYQVDSQYGNLNDFRTLMKEAHQKGIKVIMDLVINHSSSEHPWFKEASADPQSKYHDYYVWADKNADLDEKGSWGQQVWHKNPNGEGYFYGTFWSGMPDLNFDNPEVRKEMIKVGKYWLQQGADGFRLDAAMHIFKGQTKEGADKNIAWWNEFRSEMERVNPNVYLAGEVWDKPETIAPYYGPLHSLFNFDLGGTILSSIKNGRDQGIATFAEKTLKLYKSYNKAALDAPFLSNHDQTRVMSELGGDVRKAKLAASILLTLPGQPFLYYGEEIGMKGEKPDEYLREPMRWYKGDGPGQTTWEEPKYNTGEVSVEAQLQDDDSLLQSYRTLIRLREEHEALRSDSLEPVQTDSASVTAFRRTSGKETLYLYHNLSGEPVTLQIKDLDKGKWKVVFSTSKDVKVKKGTVMIPAYSSLIIKEDRKS

SEQ ID NO: 3015 - protein, 533 aa, Paenibacillus sp.
MTRNKRLRKWSTILLTVPMLTMFASSAMAEQDMNGHKPPTSAGSGVFYEIYINSFYDSNGDGHGDLKGITQKLDYLNDGNPRSGKDLQVSGLWLMPLNPSPSYHKYDVTDYYQVDPQYGNLNDFRTLTKEAKRKGVKVIIDLVINHSSSEHPWFKEASANPQSKYHDYYVWADENTNLDEKGSWGQQVWHKNPNGEGYFYGTFWSGMPDLNFDNPEVRKEMIKVGKYWLQQGADGFRLDAAMHIFKGQTKDGADKNIAWWNEFRSEMEKINPNVYLAGEVWDKPETIAPYYESLHSLFNFDLGGTILNSVKNGRDQGIATFSEKTLKLYKSYNKAALDAPFLSNHDQTRVMSELGGDVRKAKLAASILLTLPGQPFLYYGEEIGMKGEKPDEYLREPMRWYKGEGLGQTKWEEPKYNKGEVSVEAQLRDNDSLLESYRTLIRLREEHEALRSDSLEPIQAGSASVTAYKRSSGKETLYVYHNLSGEPVTIQMKDRDKEKRKVVFSTSKDAKVRKETVTIPAYSSLITQEDRKS

SEQ ID NO: 3016 - protein, 533 aa, Paenibacillus sp.
MTRNKRLRKWSTILLTVPMLTMFASSAMAEQDMNGHKPPNSAGSGVFYEIYINSFYDSNGDGHGDLKGITQKLDYLNDGNPRSGKDLQVSGLWLMPLNPSPSYHKYDVTDYYQVDPQYGNLNDFRTLTKEAKRKGVKVIIDLVINHSSSEHPWFKEASANPQSKYHDYYVWADENTNLDEKGSWGQQVWHKNPNGEGYFYGTFWSGMPDLNFDNPKVRKEMIKVGKYWLQQGADGFRLDAAMHIFKGQTKDGADKNITWWNEFRSEMEKINPNVYLAGEVWDKPETIAPYYESLHSLFNFDLGGTILNSVKNGRDQGIATFSEKTLKLYKSYNKAALDAPFLSNHDQTRVMSELGGDVRKAKLAASILLTLPGQPFLYYGEEIGMKGEKPDEYLREPMRWYKGEGLGQTKWEEPKYNKGEVSVEAQLRDNDSLLESYRTLIRLREEHEALRSDSLEPIQAGSASVTAYERSSGKETLYVYHNLSGEPVTIQMKDRDKEKRKVVFSTSKDAKVRKETVTIPAYSSLITQEDRKS

SEQ ID NO: 3017 - protein, 533 aa, Paenibacillus sp.
MTRNQRLRKWSTILLTVPMLTMFTSGAMAEQDMNGHKPPNSAGSGVFYEIYINSFYDSNGDGHGDLKGITQKLDYLNDGNPRSGKDLQVSGLWLMPLNPSPSYHKYDVTDYYQVDPQYGNLNDFRTLTKEAKRKGVKVIIDLVINHSSSEHPWFKEASANPQSKYHDYYVWADENTNLDEKGSWGQQVWHKNPNGEGYFYGTFWSGMPDLNFDNPEVCKEMIKVGKYWLQQGADGFRLDAAMHIFKGQTKDGADKNIAWWNEFRSEMEKINPNVYLAGEVWDKPETIAPYYESLHSLFNFDLGGTILNSVKNGQDQGIATFAEKTLKLYKSYNRAALDAPFLSNHDQTRVMSELGGDVRKAKLAASILLTLPGQPFLYYGEEIGMKGEKPDEFLREPMRWYKGEGLGQTKWEEPKYNKGEVSVEAQLRDNDSLLASYRTLIRLREEHEALRSDNLEPFQAGSANVAAYKRSSGKETLYIYHNLSGEPVTLQMKDWDKQKRKVVFSSSKDLKVKKDTVKIPAYSSLITKEDRKS

SEQ ID NO: 3018 - protein, 82 aa, Paenibacillus sp.
MLKKMKIMVVVALMISSFGAAVAFAENSQNNMGTNDNGRTQMLTTNNNDDDNDNDNWGWLGLLGLIGLAGLKRRDHENSKKR

SEQ ID NO: 3019 - protein, 82 aa, Paenibacillus sp.
MLKKMKIMVVVALMISCFGAAVAFAENGDTNMGTNDNGRTQMLTTNNNDNDNDNDNWGWLGLLGLIGLAGLKRREPENHKKR

SEQ ID NO: 3020 - protein, 83 aa, Paenibacillus sp.
MLKKAKIMVVVALMISSFGAAVAFAENSENNMGTNNNGRTQMLTTNNDDDNDNDNDNWGWLGLLGLIGLAGLKRRDHENPKKR

SEQ ID NO: 3021 - protein, 82 aa, Paenibacillus sp.
MLKKMKIMAVVALMISSFGAAVAFAENSQNNMGTNDNGRTQMLTTTNNNDNDNNNNWGWLGLLGLIGLAGLKRREPENHSKR

SEQ ID NO: 3022 - protein, 82 aa, Paenibacillus sp.
MLKKMKIMAVVALMISSFGAAVAFAENSQNNMDTNDNGRTQMLTTTNNNDNDNNNNWGWLGLLGLIGLAGLKRREPENHSKR

SEQ ID NO: 3023 - protein, 85 aa, Paenibacillus sp.
MLKKMKIIVVVALMISCFGAVVAFAENSETNMGTNDNGRTQMLTTNNNDDNNDNDNWGWLGLLGLIGLAGLKRRDHENHKKDNRK

SEQ ID NO: 3024 - protein, 573 aa, Paenibacillus sp.
MLKRRPVSLLSLTLAITLLLSTFASVAAAAESDGQAPQAAAASSMQSYVEAMQPGWNLGNSLDAVGADETAWGNPRITQALIQQIAAQGYKSIRIPVTWDKHIGAAPNYTVESAYMNRVEEVVRWALDANLYVMINVHHDSWTWVSSMEPKHDEVLARYNALWTQIAPRFKDQPNKLMFESINEPRFSEGGTTDETKMNQMLQELNVSFHKIVRASGGKNATRPLVLPGLDTSPAQAKINELYNTITKLNDPNLIATVHYYGYWPFSVNIAGHTTFDKDTKNDIIQTFDNVYNTFVAKGIPVIVGEFGLLGFDKNTGVIEQGEKLKFFEYLTYYMKEKKITGMLWDNGQHFNRTTYKWSDPELFNVIKASLKGRSSNAASDLIHLKKGTPAQDAKVTLNLNGNQLKTLSVNNRQLTQGTDYTLSGDTLTLKASLLTSLTTSGKYGENAVITAKFNKGADWNFKVVVYDTPKLSAVEGTTQAFTIPTEFHGSQLATMEAVYTNGGNAGPQDWTPYKEFGNTFAPAYDANGIKLLPEFFNSVKDGEVTLKFHFWSGDVVTYKITKSGTRVTGTTS

SEQ ID NO: 3025 - protein, 573 aa, Paenibacillus sp.
MLKRRPVSLLSLTLAITLLLSTFASVAAAAESDGQAPQTAAASSLQSYVEAMQPGWNLGNSLDAVGADETAWGNPRITQALIQQIAAQGYKSIRIPVTWDKHIGAAPNYTVESAYMNRVEEVVRWALDANLYVMINVHHDSWTWVSSMEPKHDEVLARYSALWKQIAPRFKDQPNKLMFESINEPRFSEGGTTDEAKMNQMLQELNVSFHKIVRASGGKNATRPLVLPGLDTSPAQAKINELYNTITKLNDPNLIATVHYYGFWPFSVNIAGHTTFDTDTKNDIIQTFDNVYNTFVAKGIPVIVGEFGLLGFDKNTGVIEQGEKLKFFEFLTYYMKEKKITGILWDNGQHFNRTTYKWSDPELFNVIKSSLKGRSSNAASDLIHLKKGTSAQDAKVILNLNGNQLKTLSVSSKQLKQGTDYTLSGDTLTFKASLLTSLTTSGKYGENAVITAKFNKGADWNFKVVVYDTPKLSAVEGTTQAFTIPTDFRGSQLATMEAVYTSGGNAGPQDWTPYKEFGNTFAPAYDANGIKLLPEFFNSVKDGEVTLKFHFWSGDVVTYKITKSGNRVTGTTS

SEQ ID NO: 3026 - protein, 573 aa, Paenibacillus sp.
MLKRRPVSLLSLTLAITLLLSTFASVAAAAESDGQAPQAAAASSLQSYVEAMQPGWNLGNSLDAVGADETAWGNPRITQALIQQIAAQGYKSIRIPVTWDKHIGAAPTYTVESAYMNRVEEVVRWALDANLYVMINVHHDSWTWVSSMEPKHDEVLARYNALWTQIAPRFKDQPNKLMFESINEPRFSEGGTTDEAKMNQMLQELNISFHKIVRASGGKNATRPLVLPGLDTSPAQTKINELYNTITKLNDPNLIATVHYYGYWPFSVNIAGHTTFDKDTKNDIIQTFDNVYNTFVAKGIPVIVGEYGLLGFDKHTGVIEQGEKLKFFEFLTYYMKEKKITGILWDNGQHFNRTTYKWSDPELFNVIKASLKGRSSNADRDLIHLKKGTPTQDTKITLNLNGNQLKTLSVSSKQLTQGTDYTLSGDTLTFKASLLTSLTTSGKYGENAAITAKFNKGADWNFRVVVYDTPKLSAVEGTTQAFTIPTDFRGSQLATMEAVYTNGGNAGPQDWTPYKEFGNTFSPAYDANGIKLLPEFFNSVKDGEVTLKFHFWSGDVVTYKITKSGTRVTGTTS

SEQ ID NO: 3027 - protein, 573 aa, Paenibacillus sp.
MLKRRPVSLLSLTLAITLLLSTFASVAAAAESDGQAPQAAAASSLQSYVEAMQPGWNLGNSLDAVGADETAWGNPRITQALIQQIAAQGYKSIRIPVTWDKHIGAAPTYTVESAYMNRVEEVVRWALDVNLYVMINVHHDSWTWVSSMEPKHDEVLARYNALWTQIAPRFKDQPNKLMFESINEPRFSEGGTTDEAKMNQMLQELNISFHKIVRASGGKNATRPLVLPGLDTAPAQTKINELYNTITKLNDPNLIATVHYYGYWPFSVNIAGHTTFDKDTKNDIIQTFDNVYNTFVAKGIPVIVGEYGLLGFDKHTGVIEQGEKLKFFEFLTYYMKEKKITGILWDNGQHFNRTTYKWSDPELFNVIKASLKGRSSNADRDLIHLKKGTSAQDTKVTLNLNGNQLNTLSANSKQLKQGTDYTLSGDTLTFKASLLTSLTTSGKYGENAAITAKFNKGADWNFRVVVYDTPKLSAVEGTTQAFTIPTDFRGSQLATMEAVYTNGGNAGPQDWTPYKEFGNTFSPAYDANGIKLLPEFFNSVKDGEVTLKFHFWSGDVVTYKITKSGTRVTGTTS

SEQ ID NO: 3028 - protein, 573 aa, Paenibacillus sp.
MLKRRPVSLLSLTLAITLLLSTFASVAAAAESDGQAPQTAAASSMQSYVEAMQPGWNLGNSLDAVGADETAWGNPRITQALIQQIAAQGYKSIRIPVTWDKHMGAAPNYTVESAYMNRVEEVVRWALDANLYVMINVHHDSWTWVSSMEPKHDEVLARYNALWTQIAQRFKDQPNKLMFESINEPRFSEGGTTDEAKMNQMLHELNVSFHKIVRASGGKNATRPLVLSGLDASPTQAKINELYNTITKLNDPNLIATVHYYGFWPFSVNIAGYTTFEKDTKNDIVQTFDNVYNTFVAKGIPVIVGEYGLLGFDKHTGVIEQGEKLKFFEFLTHYMKEKKVTGMLWDNGQHLNRTTYKWSDPELFNVIKASLKGRSSNADRDLIHLKKDSPVQDTKVTLNLNGNQLKSLHTGSKQLKQDTDYTLSGDTLTFKASLLTSLTTSGKYGENAVITAKFNKGADWNFKVVVYDTPKLSAVEGTTQAFTIPTDFRGSQLATMEAVYTNGGNAGPQDWTPYKEFGNTFAPAYDANGIKLLPEFFNSVKDGKVTLKFHFWSGDVVTYKITKSGTRVTGTTS

SEQ ID NO: 3029 - protein, 573 aa, Paenibacillus sp.
MLKRRPISLLSLTLAITLLLSTFASVAAAAETDEQAQPAAATSNMQSYVEAMQPGWNLGNSLDAVGADETAWGNPRITQALIQQIAAQGYKSIRIPVTWDKHIGAAPHYTVESAYMNRVEEVVRWALDANLYVMINVHHDSWTWVSSMEPKHDEVLARYNALWTQIADRFKNQPNKLMFESINEPRFSEGGTTDEAKMNQMLHELNVSFHKIVRASGGKNATRPLVLPGLDTSPAQAKINELYNTITKLNDPNLIATVHYYGFWPFSVNIAGNTTFDKASQNDIVQTFDNVYNTFVAKGIPVIVGEYGLLGFDKHTGVIEQGEKLKFFEFLTYYMKEKKVTGMLWDNGQHLNRSTYKWSDPELFNVIKASLKGRSSNAASDLIHLKKGSSVQDTKITLNLTGNQLKSLNVNSKQLKQGTDYTLSGDTLTFKASLLTSLITSGKYGENAVITAKFNKGADWNFRVVVYDTPKLSAVEGTTQAFTIPTDFRGSQLATMEAVYTNGGNAGPQDWTPYKEFGNTFAPAYDTNGIKLLPEFFNSVKDGEVTLKFHFWSGDVVTYKITKNGTRVTGTTS

SEQ ID NO: 3030 - protein, 573 aa, Paenibacillus sp.
MLKRRPISLLSLTLAITLLLSTFASVAAAAETNEQAQPAAATSNMQSYVEAMQPGWNLGNSLDAVGADETAWGNPRITQALIQQIAAQGHKSIRIPVTWDKHIGAAPHYTVESAYMNRVEEVVRWALDANLYVMINVHHDSWTWVSSMEPKHDEVLARYNALWTQIADRFKNQPNKLMFESINEPRFSEGGTTDEAKMNQMLHELNVSFHKIVRASGGKNATRPLVLPGLDTSPAQAKINELYNTITKLNDPNLIATVHYYGFWPFSVNIAGNTTFDKAAQNDIVQTFDNVYNTFVAKGIPVIVGEYGLLGFDKHTGVIEQGEKLKFFEFLTYYMKEKKVTGMLWDNGQHLNRSTYKWSDPELFNVIKASLKGRSSNAASDLIHLKKGSSVQDTKITLNLNGNQLKSLNANSKQLKQGTDYTLSGDTLTFKASLLTSLITSGKYGENAVINTKFNKGADWNFKIVVYDTPKLSAVEGTTQAFTIPTDFRGSQLATMEAVYTNGGNAGPQDWTPYKEFGNTFAPAYDTNGIKLLPEFFNSVKDGEVTLKFHFWSGDVVTYKITKSGTRVTGTTS

SEQ ID NO: 3031 - protein, 573 aa, Paenibacillus sp.
MLKRRPISLLSLTLAITLLLSTFASVAAAAETDGQAQPAAATSNMQSYVEAMQPGWNLGNSLDAVGADETAWGNPRITQALIQQIAAQGYKSIRIPVTWDKHIGAAPHYTVESAYMNRVEEVVRWALDANLYVMINVHHDSWTWVSSMEPKHDEVLARYNALWTQIADRFKNQPNKLMFESINEPRFSEGGTTDEAKMNQMLHELNVSFHKIVRASGGKNATRPLVLSGLDAAPAQAKISQLANTITGLNDPNLIATVHYYGFWPFSVNIAGNTTFDKAAQDDIIQTFDNVYNTFVAKGIPVIVGEYGLLGFDKHTGVIEQGEKLKFFEFLTYYMKVKKVTGMLWDNGQHLNRSTYKWSDPELFNVIKASLKGRSSNAASDLIHLKKGSSVQDTKITLNLNGNQLKSLNANSKQLKQGTDYTLSGDTLTFKASLLTSLITSGKYGENAVITAKFNKGADWNFKVVVYDTPKLSAVEGTTQAFTIPTDFRGSLLATMEAVYTNGGNAGPQDWTPYKEFGNTFAPSYDTNGIKLLPEFFNSVKDGEVTLKFHFWSGDVVTYKITKNGTRVTGTTS

SEQ ID NO: 3032 - protein, 573 aa, Paenibacillus sp.
MLKRKPVSLLSLTLAITLVLSMFTSVAAAAESDGQAQPAAATRNMQSYVEAMQPGWNLGNSLDATGADETSWGNPRITQALIQQIAAQGYKSIRIPVTWDKHIGAAPNYTVESAYMNRVDEVVRWALDANLYVMINVHHDSWMWVSSMEPKHDEVLARYNAIWTQIAKHFKDKPDKLMFESINEPRFTEGGTTDEAKANQMLQELNVSFHKIVRASGGNNATRPLVLPGLDTSPAQNKINELYNTMTKLKDPNLIATVHYYGYWPFSVNIAGHTTFDQDTKNDITQTFDNVYNTFVAKGIPVIVGEFGLLGFDKNTGVIEQGEKLKFFEFLTYYLKEKKITGILWDNGQHFNRTTYKWSDPELFNVIRASLKGRSSNAASDLIHLKKGASVQDAKVTLNLNGNQLSTLSANSKQLKQGTDYTLSGNTLTFKASLLTSLITSGKYGENAVINAKFNKGADWNFKVVVYDTPKLSATEGTTQAFTIPTDFRGSQLATMEAVYTNGGNAGPQDWTSYKEFGNTFTPAYDTNGIKLLPEFFNSVKDGEVTLKFHFWSGDVVTYKITKSGTRVTGKAS

SEQ ID NO: 3033 - protein, 573 aa, Paenibacillus sp.
MLNRKPVSLLSLTLAITLVLSMFASIAAAAESDERARPAAATRNMQSYVEAMQPGWNLGNSLDATGADETSWGNPRITQALIQQIAAQGYKSIRIPVTWDKHIGAAPNYTVEPAYMNRVDEVVRWALDANLYVMINVHHDSWMWVSSMEPKHDEVLARYNAIWTQIAKHFKDKPDKLMFESINEPRFTEGGTSDEAKANQMLQELNVSFHKIVRASGGNNATRPLVLPGLDTSPAQNKINELYNTMTKLNDRNLIATVHYYGYWPFSVNIAGHTTFDKETKDDITQTFDNVYNTFVAKGIPVIVGEFGLLGFDKNTGVIEQGEKLKFFEFLTYYLKEKKITGILWDNGQHFNRTAYKWSDPELFNVIKAGLKGRSSNAASDLIHLKKGTAVQDAKVTLNLNGNQLSSLSVNNKQLKKGTDYTLSGDTLTFKASLLTSLITSGKYGENAVINAKFNKGADWNFKVVVYDTPKLSATEGTTQAFTIPTDFRGSQLATMEAVYTNGGNAGPQDWTSYKEFGNTFTPAYDANGIKLLPEFFNSVKDGEVTLKFHFWSGDVVTYKITKSGTRVTGKVS

SEQ ID NO: 3034 - protein, 575 aa, Paenibacillus sp.
MIKRKYKSLLSLTMAAALLLSLIPSAASAASTEEAVQPKAAAATNMQSYVDAMQPGWNLGNTLDATGADETSWGNPRITQTLIKQIAAQGYKSIRIPVTWDTHIGAAPNYTIDPAYLSRVEEVVNWALNENLYVMINVHHDSWLWISKMETQHDTVLARYNAVWKQIADRFKNSSNKLMFESVNEPRFTDGGTTDEGKQQQMLDELNVSFHKILRASGGQNATRPLVLSTLEATPSQERMTALYNTMSKLNDSNLIATVHYYGFWPFSVNIAGYTKFNEEVQKDITTTFDNVYNTFTAKGIPVILGEYGLLGFDKNTGVIEQGEKLKFFEFLGYYLKQKKIATVLWDNGQHFSRTNYTWSDPDLFNVIKTSWTGRSSNADSDLIYIKKGTTIQDKKITLNLNGNQLSSLSVGSTTLQSGTDYTLSGNILTIKASQLTKLTTSGKFGVNATITAKFSKGANWKFNVIVYDTPKLSNAQGSTSSFSIPTAFNGDQLATMEATYASGGNAGPQNWTSFKEFETTFSPVYSGNTIKLQPAFFNETKDGQVNLKFHFWSGAIINYTITKSGTTVTGTAAQ

SEQ ID NO: 3035 - protein, 358 aa, Paenibacillus sp.
MSKKLSVLVLTMVLLLTVALVGCSKKLEPKEAVTNGTANAMKLNSYESKSQFTIKELTITSASVPSEQSAMVTSMLKNADITLDGVYQKEPFQSEMTLGIHLKGDLSTSFTIPMVMTKDKLYVKIPNIPFYPLPQDVVGKFLIIDPQELAKQSGQEFNPAAMDQEKSQKFANEVIAAIMNEYDQATYFFDIDPKDAKLPQGVEAKQVVQFKITNDNVKQATNTFITKALPKVLDVMSKDEYASMLQVKKEELAEAKKELQSNTSEVSKKLDELKNYLTVKQFDINTALNKDDIPVYQDLNANVEMNDPATKDNVKLSVTGYTQYSKINAKAAFKVGIPTGDQVLTMEQLQQKMQTVAP

SEQ ID NO: 3036 - protein, 358 aa, Paenibacillus sp.
MSKKLSVLVLTMVLLLTVALVGCSKKLEPKEAVTTGTANAMKLNSYESKSQFTVKDLTISSATLPSEQSAMITSMLKNADITLDGVYQKEPFQSEMTLGIHLKGDLSTSFTIPMVMTKDKLYVKIPNIPFYPLPQDVVGKFLIIDPQELAKQSGQEFNPAAMDQEKSQKFANEVIAAIMNEYDQATYFFDIDPKDAKLPQGVEAKQVVQFKITNDNVKQATNTFITKALPKVLDIMSKDEYASMLQVKKEELSEAKKELQSNTSEVSKKLDELKNYLTVKQFDINTALNKDNIPVYQDLNANVEMNDPATKDNVKLSVTGYTQYNKINAKAAFKVGIPTADQVLTMEQLQQKMQTVAP

SEQ ID NO: 3037 - protein, 358 aa, Paenibacillus sp.
MSKKLSVLVLTMVLLMTVALVGCSKKLEPKEAVTTGTANAMKLNSYESKSQFTVKELTITSASVPAEQSAMVTSMLKNADITLDGVYQKEPFQSEMTLGIHLKGDLSTSFTIPMVMTKDKLYVKIPNIPFYPLPQDVVGKFLLIDPQELAKQTGQEFNPATMDQEKSQKFANEVIAAIMGEYDQATYFFDIDPKDAKLPQGVEAKQVVQFKITNDNVKQATNTFITKALPKVLDIMSKDEYAGMLQVKKEELAEAKKELQSNTSEVSKKLDELKNYLTVKQFDINTALNKDNVPVYQDLNANVEVNDPSTKDNVKLSVTGYSQYSKINEKASFKVGIPTADQVLTIEQLQQKMQTVSP

SEQ ID NO: 3038 - protein, 358 aa, Paenibacillus sp.
MSKKLSVLVLTMVLLMTVALVGCSKKLEPKEAVTTGTANAMKLNSYESKSQFTVKELTITSASVPAEQSAMVTSMLKNADITLDGVNQKEPFQSEMTLGIHLKGDLSTSFTIPMVMTKDKLYVKIPNIPFYPLPQDVVGKFLLIDPQELAKQTGQEFNPATMDQEKSQKFANEVIAAIMGEYDQATYFFDIDPKDAKLPQGVEAKQVVQFKITNDNVKQATNTFITKALPKVLDIMSKDEYAGMLQVKKEELAEAKKELQSNTSEVSKKLDELKNYLTVKQFDINTALNKDNVPVYQDLNANVEVNDPSTKDNVKLSVTGYSQYSKINEKASFKVGIPTADQVLTIEQLQQKMQTVSP

SEQ ID NO: 3039 - protein, 358 aa, Paenibacillus sp.
MSKKLSVLVLTMVLLLMVALVGCSKKLEPKEAVTTGTANAMKLNSYESKSQFTVKDLTISSATLPSQQSAMITSMLKNADITLDGVYQKEPLQSEMTLGIHLKGDLSTSFTIPMVMTKDKLYVKIPNIPFYPLPQDVVGKFLIIDPQELAKKSGQEFNPATMDQEKSQKFANEVIAAIMGEYDQATYFFDIDPKDAKLPQGVEAKQVVQFKITNDNVKQAVDTFVTKALPKVLDIMSKDEYAGMLQVKKEELAEAKKELQSNTSEVSKKLDELKNYLTVKQFDINTALNKDNIPVYQDLNANVEMNDPATKDNVKLSVTGYTQYSKINEKATFKVGIPTSDQVLTIEQLQQKMQTVAP

SEQ ID NO: 3040 - protein, 358 aa, Paenibacillus sp.
MSKKLSVLVLTMVLLLTVALVGCSKKLEPKEAVTTGTANAMKLNSYESKSQFTIKELTITSASVPSEQSAMVTSMLKNADITLDGVYQKEPFQSEMTLGIHLKGDLSTSFTIPMVMTKDKLYVKIPNIPFYPLPQDVVGKFLIIDPQELAKQSGQEFNPAAMDQEKSQKFANEVIAAIMNEYDQATYFFDIDPKDAKLPQGVEAKQVVQFKITNDNVKQAVDTFVTKAVPKAIDIMSKDEYISLFQLKKEDLTAAKLAVETNTSDFRKKLDELKNYLTVKQFDINTALNKDNIPVYQDLNANVEMNDPATKDNVKLSVTGYTQYSKINAKAAFKVGIPTGDQVLTMEQLQQKMQTVAP

SEQ ID NO: 3041 - protein, 358 aa, Paenibacillus sp.
MSKKLSVLVLTMVLLLTVALVGCSKKLEPKEAVTTGTANAMKLNSYEFKSQFTVKDLTISLATLPSEQSAMMTNMLKNADITLDGVYQKEPLQSEMTLGIHLKGDLSTSFTIPMVMTKDKLYVKVPNIPFYPLPQDVVGKFLVVDPQELAKQSGQEFNPAVMDQEKSQKFANEVIAAIMGEYDQATYFFDIDPKDAKLPQGVEAKQVVQFKITNDNVKQATDTFITKALPKLFDIMSKDEYAGMLQVKKEELAEAKKELQSNTSEVSKSLDELKNYLTVKQFDINTALNKDNIPVYQDLNANVEVNDPDTKDNIKLSVTGYTQSSKINEKATFKVGIPTGDQVLTIEQLQQKMQTVAP

SEQ ID NO: 3042 - protein, 358 aa, Paenibacillus sp.
MSKKLSVLVLTMVLLLTVALVGCSKKLEPKEAVTTGTTNAMKLNSYESKSQFTVKDLTITSATLPSEQSAMITSMLKNADITLDGVYQKEPLQSEMTLGIHLKGDLSTSFTIPMVMTKDKLYVKIPNIPFYPLPQDVVGKFLVVDPQELAKQSGQEFNPATMDQAKSQKFANEVIAAIMGEYDQATYFFDIDPKDAKLPQGVEAKQVVQFKITNDNVKQAADTFVTKAIPKAIDIMSKDEYISLFQLKKEDLTTVKLAVETNTSDFKKKLDELKNYLTVKQFDINTALNKDNIPVYQDLNANVEMNDPETKDNVKLSVTGYSQFSKINEKATFKVGIPTGDQVLTIEQLQQKMQTVAP

SEQ ID NO: 3043 - protein, 353 aa, Paenibacillus sp.
MSKKLSVLMLTMVLLLTVALVGCSKKDELKEAITKGTANVTKLSSYELKSQFKIKDLSISSNSLPAIQNAFITDTLKDADITLDGVYQKEPLQSEMTLGIHLKGNYSTPYTIPMVVTKDKLYVKLPDLPSYRIPKKAIGKFLEIDPKQLAEQSGSKFNPEIMDPTQVQKLVSEVVSALLSEYDQATYFFDINPKDAKLPQGVEAKQVVQFKVTNDNLKQAAGVFITKALPKAIDVISKDEYANMFQVNKEKLAEAKKKLQSNTSEVSKKFNNLTVKQFDINTALDKNDIPMYQDLNANVEWNDPTSKDNVKLFVTGYMQYSKINEKTTFKLSVPTGDQVLTIEQLQKMKTVAP

SEQ ID NO: 3044 - protein, 397 aa, Paenibacillus sp.
MKKKGMKKTFFVIASLVMGFTLYSYTPASADAASVKGYYHTQGNKIVDESGKEAAFNGLNWFGLETPNYTLHGLWSRSMDDMLDQVKKEGYNLIRLPYSNQLFDSSSRPDSIDYHKNPDLVGLTPIQIMDKLIEKAGQRGIQIILDRHRPSSGGQSELWYTSQYPESRWISDWKMLADRYKNNPTVIGADLHNEPHGQASWGTGNASTDWRLAAQRAGNAILSVNPNWLILVEGVDHNVQGNNSQYWWGGNLTGVANYPVVLDVPNRVVYSPHDYGPGVSSQPWFNDPAFPSNLPAIWDQTWGYISKQNIAPVLVGEFGGRNVDLSSPEGKWQNALVDYIGANNLYFTYWSLNPNSGDTGGLLLDDWTTWNRPKQDMLSRIMKPVVFVAEQAKATAE

SEQ ID NO: 3045 - protein, 397 aa, Paenibacillus sp.
MKKKGMKKTFFVIASLVMGFTLYGYTPASADAASVKGYYHTQGNKIVDESGKEAAFNGLNWFGLETPNYTLHGLWSRSMDDMLDQVKKEGYNLIRLPYSNQLFDSSSRPDSIDYHKNPDLVGLTPIQIMDKLIEKAGQRGIQIILDRHRPSSGGQSELWYTSQYPESRWISDWKMLADRYKNNSTVIGADLHNEPHGQASWGTGNASTDWRLAAQRAGNAILSVNPNWLILVEGVDHNVQGNNSQYWWGGNLTGVANYPVVLDVPNRVVYSPHDYGPGVSSQPWFNDPAFPSNLPAIWDQTWGYISKQNIAPVLVGEFGGRNVDLSSSEGKWQNALVDYIGANNLYFTYWSLNPNSGDTGGLLLDDWTTWNRPKQDMLSRIMKPVVFVAEQAKASAE

SEQ ID NO: 3046 - protein, 397 aa, Paenibacillus sp.
MKKKGLKKTFFVITSLVMGFTLYGYTPASVDAASVKGYYHTQGNKIVDESGKEAAFNGLNWFGLETPNYTLHGLWSRSMDDMLDQVKKEGYNLIRLPYSNQLFDSSSRPDSIDYHKNPDLVGLTPIQIMDKLIEKAGQRGIQIILDRHRPGSGGQSELWYTSQYPESRWISDWKMLADRYKNNPTVIGADLHNEPHGQASWGTGNASTDWRLAAQRAGNAILSVNPNWLILVEGVDHNVQGNNSQYWWGGNLTGVANYPVVLDVPNRVVYSPHDYGPGVSSQPWFSDPAFPSNLPAIWDQTWGYISKQNIAPVLVGEFGGRNVDLSNTEGKWQNALVDYIGANNLYFTYWSLNPNSGDTGGLLLDDWVTWNRPKQDMLSRIMKPVIFVAEQAKATAE

SEQ ID NO: 3047 - protein, 397 aa, Paenibacillus sp.
MKKKGLKKTFFVIASLVMGFTLYGYTPASADAASVKGYYHTQGNKIVDESGKEAAFNGLNWFGLETPNYTLHGLWSRSMDDMLDQVKKEGYNLIRLPYSNQLFDSSSRPDSIDYHKNPDLVGLNPIQIMDKLIEKAGQRGIQIILDRHRPGSGGQSELWYTSQYPESRWISDWKMLADRYKNNPTVIGADLHNEPHGQASWGTGNASTDWRLAAQRAGNAILSVNPNWLILVEGVDHNVQGNNSQYWWGGNLTGVANYPVVLDVPNRVVYSPHDYGPGVSSQPWFNDPAFPSNLPAIWDQTWGYISKQNIAPVLVGEFGGRNVDLSTPEGKWQNALVDYIGANNLYFTYWSLNPNSGDTGGLLLDDWTTWNRPKQDMLGRIMKPVVSVAQQAEAAAE

SEQ ID NO: 3048 - protein, 397 aa, Paenibacillus sp.
MKKKGFKKTFFVIASLVMGLTLYGYTPPSADAASVKGYYHTQGNKIVDESGKEAAFNGLNWFGLETPNYTLHGLWSRSMDDMLDQVKKEGYNLIRLPYSNQLFDSSSRADSIDYYKNPDLVGLTPIQIMDKLIEKAGQRGIQIILDRHRPGSGGQSELWYTSQYPESRWISDWKMLAERYKNNPTVIGADLHNEPHGQASWGTGDVSTDWRLAAQRAGNAILSVNPNWLILVEGVDHNVQGNNSQYWWGGNLTGVANYPVVLDVPNRVVYSPHDYGPGVSSQPWFNDSTFPSNLPAIWDQTWGYISKQNIAPVLVGEFGGRNVDSSSPEGKWQNALVDYIGANNLYFTYWSLNPNSGDTGGLLLDDWVTWNRPKQDMLSRIMKPVNFIAEQAKASAE

SEQ ID NO: 3049 - protein, 397 aa, Paenibacillus sp.
MKKKGLKKTFFVIASLVMGFTLYGYTPPSADAASMKGYYHTQGNKIVDESGKEAAFNGLNWFGLETPNYTLHGLWSRSMDDMLDQVKKEGYNLIRLPYSNQLLDSSSRPDSIDYYKNPDLVGLTPIQIMDKLIEKAGHRGIQIILDRHRPGSGGQSELWYTSQYPESRWISDWKMLAERYKNNPTVIGADLHNEPHGQASWGTGDVSTDWRLAAQRAGNAILSVNPNWLILVEGVDHNVQGNNSQYWWGGNLTGVANYPVVLDVPNRVVYSPHDYGPGVSSQPWFNDSTFPSNLPAIWDQTWGYISKQNIAPVLVGEFGGRNVDSSSAEGKWQNALVDYIGANNLYFTYWSLNPNSGDTGGLLLDDWVTWNRPKQDMLSRIMKPANFIAEQVKASAE

SEQ ID NO: 3050 - protein, 410 aa, Paenibacillus sp.
MNLFDGSCRTCRSVEEYRLKKTFFVIASLVMGFTLYGYTPASADAASVKGYYHTQGNKIVDESGKEAAFNGLNWFGLETPNYTLHGLWSRSMDDMLDQVKKEGYNLIRLPYSNQLFDSSSRPDSIDYHKNPDLVGLTPIQIMDKLIEKAGQRGIQIILDRHRPSSGGQSELWYTSQYPESRWISDWKMLADRYKNNPTVIGADLHNEPHGQASWGTGNASTDWRLAAQRAGNAILSVNPNWLILVEGVDHNVQGNNSQYWWGGNLTGVANYPVVLDVPNRVVYSPHDYGPGVSSQPWFNDPAFPSNLPAIWDQTWGYISKQNIAPVLVGEFGGRNVDLSTTEGKWQNALVDYIGANNLYFTYWSLNPNSGDTGGLLLDDWVTWNRPKQDMLSRIMKPVIFVAEQAKAAAE

SEQ ID NO: 3051 - protein, 397 aa, Paenibacillus sp.
MKRKSMKKSFFVIASLVMSFSLYGYTPGTADAASAKGYYHTSGSKIVDESGKEAAFNGLNWFGLETPNYTLHGLWSRSMDDMLDQVKKEGYNLIRLPYSNQLFDSSSRPDSIDYSKNPDLVGLTPIQIMDKLIEKAGQRGIQIILDRHRPGSGGQSELWYTSQYPESRWISDWKMLAERYKNNSTVIGADLHNEPHGQASWGTGNLSTDWRLAAQRAGNAILSVNPNWLILVEGVDHNVQGNNSQYWWGGNLIGVANYPVVLDVPNRVVYSPHDYGPGVSSQPWFNDPAFPANLPAIWDQTWGYISKQNIAPVLVGEFGGRNVDMSSTEGKWQNALVDYIRANNLYFTYWSLNPNSGDTGGLLLDDWVTWNRPKQDMLSRIMKPVIFAAEQTTPATE

SEQ ID NO: 3052 - protein, 397 aa, Paenibacillus sp.
MKRKSMKKPFLVMASLVMGFTLYGYTPASADAASVKGYYHTQGNKIVDESGKEAVFNGLNWFGLETPNYTLHGLWSRSMDDVLDQVKKEGYNLIRLPYSNQLFDSTSRPDSIDYYKNPDLVGLTPIQIMDKLIEKAGQRGIQVILDRHRADSGGQSELWYTSKYPESRWISDWKMLAERYKDNPTVIGADLHNEPHGQASWGTGNLSTDWRLAAQRAGNAVLSVNPNWLILVEGVDHNVQGNNSQYWWGGNLTGVAKYPVVLDVPNRVVYSPHDYGPGVSWQPWFNESSFPSNLPAVWDQNWGYISKQNIAPVLVGEFGGRNVDLSSPEGKWQNALVDYIGANNLYFTYWDLNPNSGDTGGLLLDDWVTWNRPKQDMLSRIMKPVTFVTGQAKATAE

SEQ ID NO: 3053 - protein, 280 aa, Paenibacillus sp.
MEVKLVVDFEAYENGQTMAKLLEELAAKPESAEVTDLIIGDWGGAYESSPDDFIPVLVKLKDHFPKLRKLFIGDMEYDECEVSWINQTNLSPLLEAFPALESFHIKGSQDLSLEPLRHNHLQELVIICGGLPVSVLQQIHNAELPELRKLELYLGVDNYGFDGNLKDVLPFLNSNPFPKLTYLGLKDSEIQDEIAIAAANAPVIGQLEVLDLSQGTLSDKGAEALLASESIKGLKYLDLSYHYMSSEMMQRWKSSGLSVNVEDQQEADEEDDWRYPSLTE

SEQ ID NO: 3054 - protein, 280 aa, Paenibacillus sp.
MEVKLVVDFEAYENGQTMAKLLEELAAKPESAEVTDLIIGDWGGAYENSPDDFIPVLVKLKDHFPKLRKLFIGDMEYDECEVSWINQTNLSPLLEAFPALESFHIKGSQDLSLEPLRHNHLQELVIICGGLPVSVLQQIHNAELPELRKLELYLGVDNYGFDGNLKDVLPFLNSNPFPKLTYLGLKDSEIQDEIAIAAADAPVIGQLEVLDLSQGTLSDKGAEALLASESIKGLKHLDLSYHYMSSEMMQRWKSSGLSVNVEDQQEADEEDDWRYPSLTE

SEQ ID NO: 3055 - protein, 280 aa, Paenibacillus sp.
MEVKLVVDYEAYENGQTMAKSIEELAAKPESAQVTDLIIGDWGGAYESSPEDFIPVLVKLKDHFPKIRKLFIGDMEYDECEVSWINQTNLSPLLEAFPALESFHIKGSQDLSLEPLRHNHLQELVIICGGLPVSVLQQICNAELPELRKLELYLGVENYGFDGNLKDILPFLDSNPFPKLTYLGLKDSEIQDEIAIAAANAPVIGQLEVLDLSQGTLSDKGAEALLASESIKGLKHLDLSYHYMSSEMMQRWKSSGLSVNVEDQQEADEEDDWRYPSLTE

SEQ ID NO: 3056 - protein, 280 aa, Paenibacillus sp.
MEVKLVVDYEAYENGQTMAKSIEELAAKPESAQITDLIIGDWGGAYESSPEDFIPVLVKLKDQFPKIRKLFIGDMEYDECEVSWINQTNLSPLLEAFPALESFHIKGSQDLSLEPLRHNHLQELVIICGGLPVSVLQQIRNAELPELRKLELYLGVENYGFDGSLKDVLPFLDSNPFPKLTYLGLKDSEIQDEIAIAAANAPVIGQLEVLDLSQGTLSDKGAEALLASESIKGLKHLDLSYHYMSSEMMQRWKSSGLSVNVEDQQEADEEDDWRYPSLTE

SEQ ID NO: 3057 - protein, 280 aa, Paenibacillus sp.
MEVKLVVDYEAYENGQTMAKSIEELAAKPESAQITDLIIGDWGGAYESSPEDFIPVLVKLKDQFPKIRKLFIGDMEYDECEVSWINQTNLSPLLEAFPALESFHIKGSQDLSLEPLRHSHLQELVIICGGLPARVLQQIRNAELPELRKLELYLGVEDYGFDGNLNDILPFLDSNPFPKLTYLGLKDSEIQDEIAIAAANAPVIGQLEVLDLSQGTLSDKGAEALLASESIKGLKHLDLSYHYMSSEMMQRWKSSGLSVNVEDQQEADEEDDWRYPSLTE

SEQ ID NO: 3058 - protein, 280 aa, Paenibacillus sp.
MEVKLVVDYEAYENGQTMAKSIEELAAKPESAQVTDLIIGDWGGAYENSPDDFIPVLVKLKDQFPKVRKLFIGDMEYDECEVSWINQTNLSPLLEAFPKLESLHIKGSQDLSLEPLRHNHLQELVIICGGLPVSVLRQIRNAELPELRKLELYLGVEDYGFDGKLEDILPFLDSNPFPKLTYLGLKDSEIQDEIAVAAANAPVIGQLEVLDLSQGTLSDQGAEALLASESIKGLKHLDLSYHYMSSEMMGRWKNSGLSVNVEDQQEADEEDDWRYPSLTE

SEQ ID NO: 3059 - protein, 280 aa, Paenibacillus sp.
MEVKLVVDYEAYENGQTMAKSIEEQAGKPESAEITDLIIGDWGGAYEQSPEDFIPVLVKHKDQFPKLRKLFIGDMEYDECEVSWINQTNLSPLLEAFPALESFYVKGSQDLSLEPLRHSHLQELVIICGGLPASVLQEIRNAELPELRKLELYLGVDQYGFDGGLKDVLPFLNDNLFPKLTYLGLKDSEIQDEIAIAAANAPVIGQLEVLDLSQGTLSDKGAEALLASESIKGLKHLDLSYHYMSDEMMKRWKSSGLSVNVEDQQQADEEDDWRYPSLTE

SEQ ID NO: 3060 - protein, 280 aa, Paenibacillus sp.
MEVKLVVDFDAYESGQTMAKLIEELAAKPDSAEITDLIIGDWGGAYENSPEDFIPVLVQHKDQFPKLRKLFIGDMEYDECEVSWINQTNLSPLLEAFPALESFYVKGSQDLSLEPLRHSHLQELVIICGGLPASVLQQIYHAELPELRKLELYLGVDEYGFDGGLKDVLPFLDNNPFPKLTYLGLKDSEIQDEIAIAAANAPVIGQLEVLDLSQGTLSDQGAEALLASESIKGLKHLDLSYHYMSSEMVERWKNSGLSVNVDDQQEADEEDDWRYPSLTE

SEQ ID NO: 3061 - protein, 279 aa, Paenibacillus sp.
MEIKLSLDYEAYEGGAVMVDLVRELAGKPESTEVTSLIIGDWGGAYEQGPEDFVEELIAQKEQFPQLKKLFIGDMGYEECEVSWINQANLGPLLQAFPQLESFTVKGSTDLELDPLNHDHLQELVIICGGLPKRVLHQIHAASLPELRKLELYLGVEDYGFDGQMEDILPFLNQNPFPKLTYLGLKDSELQDEIAIAAAQSPVLSQLELLDLSMGTLSDQGAEALLASESVRKLKHLNLSYHYMSDEMLLKWKQSGLSVDVSEQQESDEDDWRYPALTE

SEQ ID NO: 3062 - protein, 125 aa, Paenibacillus sp.
MKTSSFFLGIVLGAVASSLISRNRDMLGLSMDMGGKKSGNLVQKARTKMMDAAFPGMGEITLNKEDTHKDQDHHSPTDKTAHNAHTAKNKEENMKLIKDFISTSPDVKREVEQILKETHTAVPGL

SEQ ID NO: 3063 - protein, 125 aa, Paenibacillus sp.
MKTSSFFLGIVLGAVASSLISRNRNMLGLSMDMGGKKGGNLVQKARTKMMDAAFPGMGEITLNKEDTHKDQDHHSQTDKTAHNAHTAKNKEENMKLIKDFISTSPDVKREVEQILKETHTAVPGL

SEQ ID NO: 3064 - protein, 125 aa, Paenibacillus sp.
MKTSSFFLGIVLGAVASSLISRNRNMLGLSMDMGGKKGGNLVQKARTKMMDAAFPGMGEITLNKEDTHKDQDHHLQTDKTAHNAHTAKNKEENMKLIKDFISTSPDVKREVEQILKETHTAVPGL

SEQ ID NO: 3065 - protein, 125 aa, Paenibacillus sp.
MKTSSFFLGIVLGAVASSLISRNRNMLGLSMDMGGKKGGNLVQKARTKMMDAAFPGMGEITLNKEDTRKDQDHHSQTDKTAHNAHTAKSKEENMKLIKDFISTSPDVKREVEQILKETHTAVPGL

SEQ ID NO: 3066 - protein, 125 aa, Paenibacillus sp.
MKTSSFFLGIVLGAVASSMISRNRNMLGLSMDIGGKKGGNLVQQARTKMMDAAFPGMGEITLNKEDTHKDQDHHSQTDKTAYNAHTAKNKEENMKLIKDFISTSPDVKREVEQILKETHTAVPGL

SEQ ID NO: 3067 - protein, 125 aa, Paenibacillus sp.
MKTSSFFLGIVLGAVASTMISRNRSMLGLSMDMDGKKGGNLVQKARTKMMDAAFPGMGDITLNKQDTHKDHDHRSTTDKTAHSTHTAQNKEENMKLIKDFISTSPDVKREVEQILKETHTAVPGL

SEQ ID NO: 3068 - protein, 125 aa, Paenibacillus sp.
MKTSSFFLGIVLGAVASSLISRNRNALGLSMDMGGKKGGNLVQKARTKMMDAAFPGMGDIALNTQDTHKDHDHRSQADKTVHNAQTAKSKEENMKLIKEFISTSPDVKREVEQILKETHTAVPGL

SEQ ID NO: 3069 - protein, 125 aa, Paenibacillus sp.
MKTSSFFLGIVLGAVASSLISRNRNALGLSMDMGGKKGGNLVQKARTKMMDAAFPGMGDIALNTQDTHKDHDHRSQADKTVHNDQTAKSKEENMKLIKEFISTSPDVKREVEQILKETHTAVPGL

SEQ ID NO: 3070 - protein, 122 aa, Paenibacillus sp.
MKTSSFFLGIVLGAVASTLISRNRNMLGLSMDMDGKKGGNLVQKARTKMMDAAFPGMGDIKLNKQDTHKDHDHRSKTDNNVHTLQNKEENMKLIKDFISSSPDVKREVEQILKETHTAVPGL

SEQ ID NO: 3071 - protein, 122 aa, Paenibacillus sp.
MKTSSFFLGIVLGAVAGSMISRNRNMLGFSMNMDGKKGENLVQKARTKMMDAAFPGMGDITLNKHDTHEDHDHRSKTDKTVHTVQSKEENMKLIKDFISSSPDVKREVEQILKETHTAVPGL

SEQ ID NO: 3072 - protein, 121 aa, Paenibacillus sp.
MKTSSFFLGIVLGAVAGSMISRNRNMLGFSMNMDGKKGENLVQKARTKMMDAAFPGMGDITLNKHDTHKDQDHRSKTETAHAVQSKEENMKLIKDFISSSPDVKREVEQILKETHTAVPGL

SEQ ID NO: 3073 - protein, 386 aa, Paenibacillus sp.
MNFYSRIKLLGLLLVFLMCSIGNAQHVQAALPPQASLDLFGSKSVRTTQESVIPDLKVYPGGQTIGVKVKSSGVLVVGHHIIQESNDRKVSPGETAGIRLGDRITHMNGKPLNSLARVAEVVDEAGKNKKPLDITLCRGEQTISTKLTPAYDQDDKAWRLGLYIRDSAAGVGTLTFYAPDQGVYGALGHVITDMNTQTPIVVGSGEIVQSNVTSIAKSQSGEPGEKRAHFLKDHRVLGNIERNTNFGIFGKMSDEPQYGLYSTPIPVALANEVKEGPAEILTVLEGQQIQRFQAEIVHISQQDKPATKGLVIRIVDPKLLDKTGGIVQGMSGSPIIQNGKLIGAVTHVFVNDPKSGYGCFIEWMLRDAGIMQNNVSLKSSSNLKAS

SEQ ID NO: 3074 - protein, 378 aa, Paenibacillus sp.
MLGLLLVFLMCSIGNAQHVQAALPPQASLDLFGSKSMRTTQESVVPDLKVYPGGQTIGVKVKSSGVLVVGHHIIQESNDRKVSPGETAGIRLGDRITHMNGKPLNSLARVAEAVDEAGKNKKPLDITLCRGEQTISTKLTPAYDQDDKAWRLGLYIRDSAAGVGTLTFYAPDQGVYGALGHVITDMNTQTPIVVGSGEIVQSNVTSIAKSQSGEPGEKRAHFLKDHRVLGNIERNTNFGIFGKMSDEPQYGLYSTPIPVALANEVKEGPAEILTVLEGQQIQRFQAEIVHISQQDKPATKGLVIRIVDPKLLDKTGGIVQGMSGSPIIQNGKLIGAVTHVFVNDPKSGYGCFIEWMLRDAGIMQNNVSLKSSSNLKAS

SEQ ID NO: 3075 - protein, 386 aa, Paenibacillus sp.
MNFYSRIKLLGLLLVFLMCSLGNAQHVQAALPLQASLDLFGSKSMKTTQESVVPDLKVYPGGQTIGVKVKSSGVLVVGHHIIQESNDRKVSPGETAGIRLGDRITHMNGKPLNSLARVAEAVDEAGKNKKPLDITLCRGEQTISTKLTPAYDQEDKAWRLGLYIRDSAAGVGTLTFYAPDQGVYGALGHVITDMNTQTPIVVGSGEIVQSNVTSIAKSQSGEPGEKRAHFLKDHRILGNIERNTNFGIFGKMSDEPQNGLYSTPIPVGLANEVKEGPAEILTVLEGQQIQRFQAEIVHISQQDKPATKGLVIRVVDPKLLDKTGGIVQGMSGSPIIQNGKLIGAVTHVFVNDPKSGYGCFIEWMLRDAGIMHNKLSLKSSSNLKAS

SEQ ID NO: 3076 - protein, 386 aa, Paenibacillus sp.
MNFFSRIKLLGLLLVFLMCSLGNAQHVQAALPLQASLDLFGSKSMKTTQESVVPDLKVYPGGQTIGVKVKSSGVLVVGHHIIQESNDRKVSPGETAGIRLGDRITHMNGKPLNSLARVAEAVDEAGKNKKPLDITLCRGEQTISTKLTPAYDQEDKAWRLGLYIRDSAAGVGTLTFYAPDQGVYGALGHVITDMNTQTPIVVGSGEIVQSNVTSIAKSQSGEPGEKRAHFLKDHRILGNIERNTSFGIFGKMSDEPQNGLYSTPIPVGLANEVKEGPAEILTVLEGQQIQRFQAEIVHISQQDKPATKGLVIRVVDPKLLDKTGGIVQGMSGSPIIQNGKLIGAVTHVFVNDPKSGYGCFIEWMLRDAGIMHNKLSLKSSSNLKAS

SEQ ID NO: 3077 - protein, 386 aa, Paenibacillus sp.
MNFFSRIKLLGLLLVFFMCSLGNAQHVQAALPLQASLDLFGSKSMKTTQESVVPDLKVYPGGQTIGVKVKSSGVLVVGHHIIQESNDRKVSPGETAGIRLGDRITHMNGKPLNSLARVAEAVDEAGKNKKPLDITLCRGEQTISTKLTPAYDQEDKAWRLGLYIRDSAAGVGTLTFYAPDQGVYGALGHVITDMNTQTPIVVGSGEIVQSNVTSIAKSQSGEPGEKRAHFLKDHRILGNIERNTSFGIFGKMSDEPQNGLYSTPIPVGLANEVKEGPAEILTVLEGQQIQRFQAEIVHISQQDKPATKGLVIRVIDPKLLDKTGGIVQGMSGSPIIQNGKLIGAVTHVFVNDPKSGYGCFIEWMLRDAGIMHNKLSLKSSSNLKAS

SEQ ID NO: 3078 - protein, 384 aa, Paenibacillus sp.
MNFYSRIKLLGLLLVFLMCSIGNAKYVHAALPPHASLDWFGPKSTRTAQESVIPDLKVYPGGQTIGVKVKSSGVLVVGHHVIQESNDRKVSPGETAGIRLGDRITHMNGKPLDSLAKVAEAVDEAGKNKKPLDITLCRGEQTISTKLTPAYDSDDKAWRLGLYIRDSAAGVGTLTFYAPDQGVYGALGHVITDMNTQTPIVVGSGEIVQSNVTSIAKSQSGEPGEKRAHFLKDHRILGNIERNTNFGIFGKMSDEPQYGLYSKPIPVALANEVKEGPAEILTVLEGQQIQRFQAEIVHISQQDKPATKGLVIRIIDPKLLEKTGGIVQGMSGSPIIQNGKLIGAVTHVFVNDPKSGYGCFIEWMLRDAGIMQNNVSMTTNLKAS

SEQ ID NO: 3079 - protein, 386 aa, Paenibacillus sp.
MNFYSRIKLLGLLLVFLICCIGNAKPVHAALPPQASLELFGSHVAKTTQDSVIPDLKVYPGGQTIGVKVKSSGVLVVGHHVIQESMDRKVSPGETAGIRLGDRITHMNGKPLDSLTRVAEAVEEAGKNKKPLDITLCRGEQTISTKLTPAYDRDDKAWRLGLYIRDSAAGVGTLTFYAPDQGVYGALGHVITDMNTQTPIVVGSGEIVQSNVTSIAKSQSGEPGEKRAHFLKDHRVLGNIERNTNFGIFGKMSDEPQYGLYSKPIPVALANEVREGPAEILTVLEGQQIQRFQAEVVHISQQDKPATKGLVIRIVDPKLLDKTGGIVQGMSGSPIIQNGKLIGAVTHVFVNDPKSGYGCFIEWMLRDAGIMQNNISFKSSSNLKAS

SEQ ID NO: 3080 - protein, 386 aa, Paenibacillus sp.
MNFYSRIKLLGLLLVFLICCIGNAKQVHAALPSQASLELFGSHAVKTSQENVIPDLKVYPGGQTIGVKVKSSGVLVVGHHVIQESVDRKVSPGETAGIRLGDRITHMNGKPLDSLTKVAEAVEEAGKNKKPLDITLCRGEQTISTKLTPAYDRDDKAWRLGLYIRDSAAGVGTLTFYAPDQGVYGALGHVITDMNTQTPIVVGSGEIVQSNVTSIAKSQSGEPGEKRAHFLKDHRVLGNIERNTNFGIFGKMSDEPQYGLYSKPIPVAFANEIKEGPAEILTVLEGQQIQRFQAEVVHISQQDKPATKGLVIRIVDPKLLDKTGGIVQGMSGSPIIQNGKLIGAVTHVFVNDPKSGYGCFIEWMLRDAGIMQNNVSLKSSSNLKAS

SEQ ID NO: 3081 - protein, 369 aa, Paenibacillus sp.
MCSLGNAHHVQAALPLQASLDLFGTKSMQTTQESVVPDLKVYPGGQTIGVKVKSSGVLVVGHHIIQESNDRKVSPGETAGIRLGDRITHMNGKPLNSLARVAEAVDEAGKNKKPLDITLCRGEQTISTKLTPAYDQDDKAWRLGLYIRDSAAGVGTLTFYAPDQGVYGALGHVITDMNTQTPIVVGSGEIVQSNVTSIAKSQSGEPGEKRAHFLKDHRILGNIERNTSFGIFGKMSDEPQNGLYSAPIPVGLANEVKEGPAEILTVLEGQQIQRFQAEIVHISQQDKPATKGLVIRVVDPKLLDKTGGIVQGMSGSPIIQNGKLIGAVTHVFVNDPKSGYGCFIEWMLRDAGIMHNKLSLKSSSNLKAS

SEQ ID NO: 3082 - protein, 350 aa, Paenibacillus sp.
MKTGNRTIVFAMLILLSSLLYPFGSVGLGAASAAPAFAKGADISWVAGMEAQGMTWKDKKGVRRDILQILRDDYQINSVRIRVWVNPDMKDYASGYMNAEKAAELAQRAKKLGMSVMLTLHYSDSWADPGQQNKPYAWRNFTFTQLMDAVWSHTVYVMNTMKSKGVTPDWVQIGNETNNGMLWEDGKASVNMKNYAWLVNTGNNAVKSVSSSTKTIVHLANGDNGSVLNWNIGGLIDNGAQFDLIGLSLYPSPSDWQGKVDQTITNANNLIAKYGKGIVISEIGMEYNEPAASKAFISAIKTKVRNIGGGKGTGVFYWEPAATPGYNQGYNKGAWQADGKPTSALEGFLN

SEQ ID NO: 3083 - protein, 350 aa, Paenibacillus sp.
MKTGNRTMVFAMLILLSSLLYPLGSVGLGAASAAPAFAKGADISWVAGMEAQGMTWKDKKGVRRDILQILRDDYQINSVRIRVWVNPDMKDNASGYMNAEKAAELAQRAKKLGVSVMLTLHYSDSWADPGQQNKPYAWRNFTFTQLMDAVWSHTVYVMNTMKSKGVTPDWVQIGNETNNGMLWEDGKASVNIKNYAWLVNTGNNAVKSVSSSTKTIVHLANGDNGSVLNWNIGGLIDNGAQFDLIGLSLYPSPSDWQGKVDQTIANANNLIAKYGKGIVISEIGMEYNEPAASKAFISAIKTKVRNIGGGKGIGVFYWEPAATPGYNQGYNKGAWQADGKPTSALEGFIN

SEQ ID NO: 3084 - protein, 350 aa, Paenibacillus sp.
MKTGNRTMVFAMLILLSSLLYPFGSVGLGAASAAPAFAKGADISWVAGMEAQGMSWKDKKGVRRDILQILRDDYQINSVRIRVWVNPDMKDYASGYMNAEKAAELAQRAKKLGMSVMLTLHYSDSWADPGQQNKPYAWRNFTFTQLMDAVWSHTVYVMDTMKSKGVTPDWVQIGNETNNGMLWEDGKASVNMKNYAWLVNTGNNAVKSVSSSTKTIVHLANGDNDSVLNWNIGGLIDNGAQFDLIGLSLYPSPSDWQGKVDQTITNANNLIAKYGKGIVISEIGMEYSEPAASKSFIFAIKTKVRNIGGGKGTGVFYWEPAATPGYNQGYNKGAWQADGKPTSALEGFIN

SEQ ID NO: 3085 - protein, 350 aa, Paenibacillus sp.
MKTGKRTMVFAMLILLSSFLYPLGSVGVGAASAAPAFAKGADISWVAGMEAQGMTWKDKKGVRRDVLQILRDDYQINSVRIRVWVNPDMKDYASGYMNAEKAAELAQRAQKLGMSVMLTLHYSDSWADPGQQNKPYAWRNFTFTQLMDAVWSHTVYVMNTMKSKGVTPDWVQIGNETNNGMLWDDGKASVNMKNYAWLVNAGNNAVKSVSSSTKTIVHLANGDNSSVLNWNIGGLIDNGAQFDLIGLSLYPSSSDWQGKVDQTITNANSLIAKYGKGIVISEIGMEYNEPAASKAFISAIKTKVRSIGGGKGVGVFYWEPAATPGYNQGYNKGAWQADGKPTSALEGFLN

SEQ ID NO: 3086 - protein, 350 aa, Paenibacillus sp.
MKTGKRTMVFAMLILLSSFLYPLGSVGVGAASAAPAFAKGADISWVAGMEAQGMTWKDKKGVRRDVLQILRDDYQINSVRIRVWVNPDMKDYASGYMNAEKAAELAQRAQKLGMSVMLTLHYSDSWADPGQQNKPYAWRNFTFTQLMDAVWSHTVYVMNTMKSKGVTPDWVQIGNETNNGMLWDDGKASVNMKNYAWLVNTGNNAVKSVSNSTKTIVHLANGDNSSVLNWNIGGLIENGAQFDLIGLSLYPSSSDWQGKVDQTITNANSLIAKYGKGIVISEIGMEYNESAASKAFISAIKTKVRSIGGGKGVGVFYWEPAATPGYNQGYNKGAWQADGKPTSALEGFLN

SEQ ID NO: 3087 - protein, 350 aa, Paenibacillus sp.
MKTGKRTMVFAMLILLSSFLYPLGSVGVGAASAAPAFAKGADISWVAGMEAQGMTWKDKKGVRRDVLQILRDDYQINSVRIRVWVNPDMEDYASGYMNAEKAAELAQRAQKLGMSVMLTLHYSDSWADPGQQNKPYAWRNFTFTQLMDAVWSHTVYVMNTMKSKGVTPAWVQIGNETNNGMLWDDGKASVNMKNYAWLVNTGNNAVKSVSSSTKTIVHLANGDNSSVLNWNIGGLIENGAQFDFIGLSLYPSSSDWQGKVDQTITNANSLIKKYGKGIVISEIGMEYNEPAASKAFISAIKTKVRSIGGGKGVGVFYWEPAATPGYNQGYNKGAWQADGKPTSALEGFLN

SEQ ID NO: 3088 - protein, 350 aa, Paenibacillus sp.
MKTSNRFILFAVLILLSSVLYPFGSAGLGTASAAPAFAKGADISWVAGMEAQGMTWKDKKGVRRDVLQILRDDYQINSVRIRVWVNPNMNDYASGYMNAEKAAELAQRAKKLGMSVMLTLHYSDSWADPGQQNKPYAWRNFNFTQLMDAVWSHTVYVMNTMKSKGVTPDWVQIGNETNNGMLWDDGKASVNMKNYAWLVNTGNNAVKSVSSSTKTIVHLANGDNGSTLNWNIGGLIDNGAQFDLVGLSLYPSSSDWQGKVDQTIANANSLIAKYGKGIVISEIGMDYNEPAASKAFIAAIKTKVRNIGGGKGAGVFYWEPAATPGYNKGYNKGAWQADGKPTSALEGFLN

SEQ ID NO: 3089 - protein, 350 aa, Paenibacillus sp.
MKKHRNRFGLIFLSLSMLLMLLGPSGEDRKAEAAPAFAKGADISWVAGMEAAGYKWKDKNGVQRDILQILKNDYQMNSVRLRVWVNPNMSDYVNGYMNAEKAADLALRAKNLGMSVMLTLHYSDSWADPGQQNKPYAWRNYTFQQLMDAVWSHTIYVMNTMKNKGVTPDWVQIGNETNDGMLWNDGKASVNMKNYAWLVNTGHNAVKSISPNTKTIVHLANGHDQAVLDWNIGGLVQNGANFDVIGLSLYPSASDWTTKVNQTITNANQLISKYGKEIVISEIGMDYNQASAAKSFITKIKNDVRNISGGKGLGVFYWEPQATPGYNGGYNKGAWNADGKPTIALEGFIN

SEQ ID NO: 3090 - protein, 348 aa, Paenibacillus sp.
MRGMKSVLLLVLSLSLLLVPWSTGVSTTVEAAPAFAKGADISWVAGMEAQGYTWRNKQGVQKDVLQILRDDYQINSVRIRVWVNPNMNDYGNGYMNADKAAELAARAKKLGMSVMLTLHYSDSWADPGKQNKPYAWRNHNFQQLMDAVWSHTVYVMNTMKNKGVTPDWVQIGNETSDGMLWPDGRASQNMKNYAWLVNTGHNAVKSVSSSTKTIVHLATGEDRALFEWNIGGLIDNGANFDMVGMSLYPSKSDWQSKVNQTIQNANNVISKYKKDVVISEIGLEYNEAAAAKSFISDIKQKVRNLSGGRGKGVFYWEPAATPGYNDGYNKGAWGTDGRPTQALEGFLN

SEQ ID NO: 3091 - protein, 350 aa, Paenibacillus sp.
MTGVAKGVWFRMFLCMSMLALTFGFSGNDAAEAAPAFAKGADISWVPGMEAQGYKWKDKTGVQRDILDILKNDYQINSARIRVWVNPNMNDYMNGYLNAEKAAELAQRAKNKGMSIMLTLHYSDSWADPGQQNKPYAWRNFTFQQLMDAVYSHTVYVMNTMKNKGVTPDWVQVGNETNNGMLWEDGKASANMKNYAWLVNTGHNAVKSVSGQAKTIVHLSNGYDNELFKWNIGGLISNGANFDIIGMSLYPEAGDWSSKVDQTIANAKDMTARYGKSIMISEIGMDYNQPAAAKSFVQSIKTKVRGLAGGTGLGVFYWEPEATPGYNAGYNKGAWQADGKPTIALEGFKD

SEQ ID NO: 3092 - protein, 344 aa, Paenibacillus sp.
MLMAALLLLLAPAWEGAGAGVGGKAEAAPAFAKGADISWVAAMEAQGYKWKDKNGVTRDIFNILKNDYGLNSARIRVWVNPNMSDYGNGYLNADKAAELAARAKAQGMSVMLSLHYSDSWADPGKQTKPYAWTGFTFNQLMDAVWSHTVYVMNTMKAKGVTPDWVQIGNETNDGMLWQDGRASVNMKNYAWLVNTGNNAVKSIFPSTKTIVHLANGYDNALFVWNIGGLIANGATFDYIGMSLYPSVSDWQTKVTQTVANANDMIARYGKSVMICEIGLDYNQPAASKSFIADIKTKIRNISGGKGLGVFYWEPQSTPGYNGGYNKGAWQADGKPTIALDGFLN

SEQ ID NO: 3093 - protein, 621 aa, Paenibacillus sp.
MNKRFRYTALLCLGVMLSGVVTPMDSQVSAASTRQMEKLSRGAVAVKVPEGVLVSWRLLGTEADSVGFNLYRGTSKVNDAPITSRTNFLDKAGTTSSSYTVRAVVNGAEQGASPAVKVWNNNYLDVPIQQPAGGTTPDNVNYTYHANDASVGDLDGDGEYEIVLKWDPSNAKDNSQSGYTGNVFLDGYELDGTRKWRIDLGRNIRAGAHYTQFLVYDFDGDGKAEIVCKTADGTVDGAGVKIGDASADYRNTSGYILKGPEFLTVFSGDTGKALSTIDYVPPRGTVSSWGDNYGNRVDRFLAGVAYLDGVRPSIVMARGYYTRTVLVAYDWRNGNLSRRWTFDSNSSTNAGTAGQGNHSLSVADVDGDDKDEIVYGSLVVDDNGAKLANTGMGHGDALHVGDLDPDRSGYEVFKVNEDKNATYGAAMYDPRNGNILWGVNTGKDTGRGMSADIDPRTKGNEQWAPGIGLRSAKGQLITNTLPSSINFGIWWDGDLLRELLDHTSSSAGKIDKWNYTNSTTSNLLTATGTSSNNGTKGTPSLQADLFGDWREEVIWRKSDNSALRIYTTPYESEHRFYTLMHDPVYRLSVAWQNVAYNQPPHTGFYLGEGMSKPQQPNIYTP

SEQ ID NO: 3094 - protein, 621 aa, Paenibacillus sp.
MNKRFRYTALLCLGVMLCGVVTPMDSQVSAASTRQMEKLNRGAVAVKVPEGVLVSWRLLGTEADSVGFNLYRGTSKVNDAPIPSRTNFLDKAGSTSSSYTVRAVVNGAEQAASPAVKVWNNNYLDVPIQQPAGGTTPDNVSYTYHANDASVGDLDGDGEYEIVLKWDPSNAKDNSQSGYTGNVFLDGYELDGTRKWRIDLGRNIRAGAHYTQFLVYDFDGDGKAEIVCKTADGTVDGTGVKIGDASADHRNTSGYILNGPEFLTVFSGNTGKALSTIDYVPPRGTVSSWGDNYGNRVDRFLAGVAYLDGVRPSIVMARGYYTRTVLVAYDWRNGNLSRRWTFDSNSSTNAGTAGQGNHSLSVADVDGDDKDEIVYGSLVVDDNGAKLANTGMGHGDALHVGDLDPDRSGYEVFKVNEDKNATYGAAMYDPRNGNILWGVNTGKDTGRGMSADIDPRTKGNEQWAPGIGLRSAKGQLITNTLPSSINFGIWWDGDLLRELLDHTSSSAGKIDKWNYTNSTTSNLLTATGTSSNNGTKGTPSLQADLFGDWREEVIWRKSDNSALRIYTTPYESEHRFYTLMHDPVYRLSVAWQNVAYNQPPHTGFYLGEGMPKLQQPNIYTP

SEQ ID NO: 3095 - protein, 621 aa, Paenibacillus sp.
MNKRFRHTVLLCLGVMLCGVVAPMDSPISAASTRQMEKLNRGTVAVKVPEGILVSWRLSGTEADSVGFNLYRGSSKVNDAPITSRTNFLDKAGTTSSSYTVRAVVNGAEQAASPAVKVWNNNYLDVPIQQPAVGTTPDHVNYTYNANDASVGDLDGDGEYEIVLKWDPSNSKDNSQSGYTGNVFLDGYELDGTRKWRIDLGRNIRAGAHYTQFLVYDFDGDGKAEVVCKTADGTVDGTGVKIGDASADHRNTSGYILKGPEFLTVFSGDTGKALSTIDYVPPRGTVSSWGDNYGNRVDRFLAGVAYLDGVRPSIVMARGYYTRTVLVAYDWRNGNLSRRWTFDSNSSTNAGTAGQGNHSLSVADVDGDDKDEIVYGSLVVDDNGAKLANTGMGHGDALHVGDLDPDRSGYEVFKVNEDKNATYGAAMYDPRNGNILWGVKTGKDTGRGMSADIDPRTKGNEQWAPSIGLRSAKGELITNTMPSSINFGIWWDGDLLRELLDHTSSSAGKIDKWNYTNSTTSNLLTATGTSSNNGTKGTPSLQADLFGDWREEVIWRKSDNSALRIYTTPYESEHRFYTLMHDPVYRLSVAWQNVAYNQPPHTGFYLGEGMSKPQQPNIYTP

SEQ ID NO: 3096 - protein, 621 aa, Paenibacillus sp.
MNKRFRYTALLCLGVILSGVVTPMDSHVSAASTRQMEKLNRGAVAVKVPEGVLVSWRLLGTEADSAGFNLYRGTSKVNAAPITSKTNFLDKAGTTSSSYTVRAIVNGAEQAASLAVKVWSNNYLDVPIQQPAGGTTPDNVSYTYHANDASVGDLDGDGEYELVLKWDPSNAKDNSQSGYTGNIFLDGYELDGTRKWRIDLGRNIRAGAHYTQFLVYDFDGDGKAEIVCKTADGTKDGTGVIIGNASADYRNASGYILDGSEFLTVFSGDTGKALSTIDYVPPRGTVSSWGDNYGNRVDRFLAGVAYLDGVRPSIVMARGYYTRTVLVAYDWRNGNLNRRWTFDSNSYANAGTAGQGNHSLSVADVDGDDKDEIVYGSLVVDDNGTKLANTGMGHGDALHVGDLDPDRSGYEVFKVNEDKNATYGAAMYDPRNGNILWGVNTGKDTGRGMSADIDPRTKGNEQWAPGIGVRSAKGELITNTLPSSINFGIWWDGDLLRELLDHTSSSAGKIDKWNYTNSTTSNLLTATGTSSNNGTKGTPSLQADLFGDWREEVIWRKSDNSALRIYTTPYESEYRFYTLMHDPVYRLSVAWQNVAYNQPPHTGFYLGEGMSKPAQPNIYIP

SEQ ID NO: 3097 - protein, 621 aa, Paenibacillus sp.
MKKRFRYTALLCLGVILCGTVTPMDSQVFAASARQMEKLNRGAVAVKVPEGVLVSWRLLGTEADLVSFNLYRGTSKVNDAPITSKTNFLDKAGTTSSSYTVRAVVNGAEQAASQAVKVWSNNYLDVPIQQPAGGTTPDNVSYTYNANDASVGDLDGDGEYEIVLKWDPSNAKDNSQSGYTGNVFLDGYKLDGTRKWRIDLGRNIRAGAHYTQFLVYDFDGDGKAEIVCKTADGTKDGTGVTIGNASADYRNASGYILDGPEFLTVFSGDTGKALSTIDYVPPRGTVSSWGDNYGNRVDRFLAGVAYLDGVRPSIVMARGYYTRTVLVAYDWRNGSLNRRWTFDSNGSTNAGTAGQGNHSLSVADVDGDDKDEIVYGSLVVDDNGTKLANTGMGHGDALHVGNLDPDRSGYEVFKVNEDKNATYGAAMYDPRNGSILWGVNTGKDTGRGMSADIDPRTKGNEQWAPGIGVRSAKGELITNTLPSSINFGIWWDGDLLRELLDHTSSSAGKIDKWNYTNSTTSNLLTATGTSSNNGTKGTPSLQADLFGDWREEVIWRKSDNSALRIYTTPYESEYRFYTLMHDPLYRLSIAWQNVAYNQPPHTGFYLGEGMSKPAQPNIYIP

SEQ ID NO: 3098 - protein, 621 aa, Paenibacillus sp.
MNKGFRYTALLCLGAMLCGMVTPMDSHVSAASTRQMEKLNRGAVAVKVPEGVLVSWRLLGTEADSVSFNLYRGTSKVNTTPITSRTNFLDKAGTTSSSYTVRAVVNGTEQAASPAVKVWSNNYLDVPIQQPAGGKTPDNVSYTYNANDASVGDLDGDGEYELVLKWDPSNSKDNSQSGYTGNVFLDGYELDGTRKWRIDLGRNIRAGAHYTQFLVYDFDGDGKAEIVCKTADGTVDGTGVKIGNASADHRNSNGYILNGPEFLTVFAGNTGKALSTIDYVPSRGSVSSWGDNYGNRVDRFLAGVAYLDGVRPSIVMARGYYTRTVLVAYDWRNGNLSRRWTFDSNSSTNPGTAGQGNHSLSVADVDGDDKDEIVYGSLVVDDNGAKLVNTKMGHGDALHVGDLDPDRSGYEVFKVNEDKNASYGAAMYDPRNGNILWGVKTGKDTGRGMSADIDPRTKGNEQWAPGIGVRSAKGELITDKLPSSTNFGIWWDGDLLRELLDHTSSSAGKIDKWNYTNSTSSNLLTATGTSSNNGTKATPSLQADLFGDWREEAIWRKSDNSALRIYTTPYESEHRFYTLMHDPVYRLSVAWQNVAYNQPPHTSFYLGEGMSKPRQPSIYTP

SEQ ID NO: 3099 - protein, 628 aa, Paenibacillus sp.
MNSWYRKPLKWAVIALSSAILGTALLTSAPAQAAAARQMEKLDRGLTAVKINGGVLVSWRLLGTDAGSVSFNLYRGSTKVNASPITSKTNYLDAAGTTSSSYTVRAIVGGVEQAASPPASVWANNYLDVPLQIPAGGTTPDGVSYTYQPNDASVGDLDGDGSYEIVVKWDPTNAKDNSQGGYTGNVYLDAYELNGTRLWRINLGRNIRAGAHYTQFLVYDFNGDGKAEVVCKTADGTVDGTNVTIGSATADHRNSGGYILAGPEYLTVFAGNTGAALSTVSYDPPRGNVSDWGDGYGNRVDRFLAGVAYLDGVRPSIVMARGYYTRAVLVAYDWRNGALTKRWTFDSNSSANAGTAGQGNHQLAVADVDGDSKDEIVYGAFVVDDNGTKLVNTSRGHGDALHVGDLDPSRPGLEVFKVNESSPYGAYSYDPKTGSILWSVTASADTGRGMTADIDPRYLGEEMWATNGVGLRTAKGVLITNSSPASVNFGIWWDGDLQRELLDHTWSGSTSTGVGKIEKWNYATSSVTNLLTASGTLSNNHTKGTPSLQADLFGDWREEVIWRKSDNSALRIYTTPYETSHRFYTLMHDPVYRLSIAWQNVAYNQPPHTGFYLGEGMAAQPVPDLYTP

SEQ ID NO: 3100 - protein, 631 aa, Paenibacillus sp.
MGTWRRTCRNVALAAIGSMVLAGMYSGGESSMAAAAPRQMEQLDRGAIAVPVEGGMLVSWRMLGTEPAHVSYDVYRDSLKINEAPITASTNFLDTSGTTSSEYTIKAILNGEPQAESSPAMVWNDTYMDVPIQQPAGGTTPDGVVYTYNANDASVGDLDGDGKYEIVLKWDPSNSKDNSQSGHTGPVYLDAYQLDGTLKWRINLGRNIRAGAHYTQFLVYDFDGDGRAEIVSKTGDGTIDGVGQVIGNATADYRNSAGYVLSGPEYLTVFDGDTGQALTTIDYEPPRGSVSSWGDNYGNRVDRFLAGVAYLDGTRPSIVMARGYYTRSVLVAYDWRDGELTRRWIFDSNAPANAGTAGQGNHSLSVADVDNDGRDEIIYGSMVVDDDGTLLVNTKMGHGDALHVGDLNPDRPGLEVFKVNEDRNGKYGAAMYDPQTGEILWGVHTGVDTGRGMSADIDPRYKGAEQWASGNVGLRTATGELISSTSPSSRNFGIWWDGDLLRELLDHTRSSNNETGVGKIEKWDYINESPVLLLNADGTLSNNGTKGTPALQADLFGDWREEVIWRTADNSALRIYSTPYETEHRFYTLMHDPVYRLSIAWQNVAYNQPPHTGFYLGEGMESPPQPAIYTP

SEQ ID NO: 3101 - protein, 625 aa, Paenibacillus sp.
MDKRKRFLLRSTAALLFAATLAVSPALPQPEAHAAARQAEKLNRGVVAVPMSSGVFVSWRLLGTEDSTVSFNLYRNGTKVNSTPITNSTNYQDPGGTTSSTYTVKAVVNGTEQTASPAAGVWGSGYLDVPIQKPAGGTTPDGVAYTYSANDASVGDLDGDGDYEIVLKWDPSNSKDNSQSGYTGNVYLDAYELDGTRKWRIDLGKNIRAGAHYTQFLVYDFDGDGKAEVVCKTADGTKDGAGVTIGSSTADYRNSSGYILDGPEYLTVFSGTNGAALSTIDYVPPRGTVSSWGDSYGNRVDRFLAGVAYLDGVRPSIIMARGYYTRTVVVAFDWRSGSLTRKWTFDSNSSTNGSATAGQGNHNLSIADVDGDGKDEIAYGSLGIDDNGAKLYVTGLGHGDAMHLSDLNPDRAGLEVFQVHESTSAAYGAEIHDAKTGAVLWGKNTGADTGRGMAADIDPRYKGAELWASGVGLHTVTGTQISSSAPGSINFAIWWDGDLSRELLDHTGGTGKIDKWDYNAGSLTRLLTATGTSSNNSTKGNPSLQADLIGDWREEVIWRTSDSTALRIYTTNAVTTTKLHTLMHDPVYRLGVAWQNVGYNQPPHTSYYLGTGMSTPAKPSIYTTP

SEQ ID NO: 3102 - protein, 153 aa, Paenibacillus sp.
MTIAFIVVAAVAFIFLLVFNTKMTRKSSPKTRPTEEESRQRSKRPYPVQVEPEVRERIDSTREMPHKDIDVEERHAEEQHKVPDIQTDKKVEKDRENIKDAYGDQDYRAALRGFARKEEEKDGRSQISNGEKETHKSEDEQYREALRSMNQKK

SEQ ID NO: 3103 - protein, 153 aa, Paenibacillus sp.
MTIAFIVVAAVAFIFLLVFNTKMTRKSSPKTRPTEEESRQRSKRPYPVQVEPEARERIDSTREMPHKDIGVEEHYAEEQHKVPDIQTDKKVEKDRENIKDAYGDQDYRAALRGFARKDEEKDGRSQISNGEKETHKSGDEQYREALRSMNQKK

SEQ ID NO: 3104 - protein, 153 aa, Paenibacillus sp.
MTIAFIVVAAVAFIFLLVFNTKMTRKSSPKTHPTEEDTRQRSKRPYPVQVEPEVRELTDHTREMQHKNLDVEEHHAQEQHKVPDIQTDKKVEKDRENLKDAYGDQDYRAALRGFAGKDEEKDGRSQISNGEKETHKSEDEQYREALRSMNQKK

SEQ ID NO: 3105 - protein, 153 aa, Paenibacillus sp.
MTIAFIVVAAVAFIFLLVFNTKMTRKSSPKTRSTEEDSRQRSKRPYPVQVEPEAREWKDPTQDMPPKDIDVEEHHVEEQHKAPDIQTDKKVGKDRENIKDAYGDQDYRAALRGFAKKDEEKDRRSPISNGEKETHKSEDEQYREALRSMNQKK

SEQ ID NO: 3106 - protein, 153 aa, Paenibacillus sp.
MTIAFIVVAAVAFIFLLVFNTKMTRKSSSKTRSTEEDSRQRSKRPYPEQVEPEAREWIDPAQETPPKDIDVEEHHAEEQHKVPDIQTDKKVEKDRENIKDAYGDQDYRAALRGFAKKDEEKERHSPISNGEKETHKSEDEQYREALRSMNQKK

SEQ ID NO: 3107 - protein, 153 aa, Paenibacillus sp.
MTIAFIVVAAVAFIFLLVFNTKMTRKSSRKTHPTEEDTRQRSKRPYPVHVEPEAREWTDPTQDMPPKDIDVEEHHAEEQHKAPDIQTDKKVEKDHENIKDAYGDQDYRAALRGFAKKDEEMDRRSPISNGEKETHKSEDEQYREALRSMNQKK

SEQ ID NO: 3108 - protein, 153 aa, Paenibacillus sp.
MTIAFIVVAVVAFIFLLVFNTKMTRKSSAKNRPNQEESRQRSKRPYPVQVEPKAHELTEHTGEIQPKNSSVEEHRAEEQHKLPDIQTDIKVEKDRENTEGAYGDQDYRAALRGFAGKDEEKDGHSRLSNGEKENSKSEDEQYREALRSMNRKK

SEQ ID NO: 3109 - protein, 153 aa, Paenibacillus sp.
MTIAFIVVAVVAFIFLLVFNTKMTRKSSAKNRPNQEESRQRSKRPYPVQVEPKAHELTEHTGEIQPKNSSVEEHRAEGQHKLPDIQTDIKVEKDRENTEGAYGDQDYRAALRGFAEKDEEKDGHSRLSNGEKENSKSEDEQYREALRSMNRKK

SEQ ID NO: 3110 - protein, 153 aa, Paenibacillus sp.
MTIAFIAVAVVALIFLLVFNTKMTRKSSTKNRPSQEESRQRSKRPYPVQVEPKAHELTEHNGEMPPKDSEVEEHRAKEHQKLPDIQTDMKVEKDRKNIEGAYGDQDYRAALRGFAGKDGEKDGGSPRSNGKKGTSKSKDEQYREALRSMNQKK

SEQ ID NO: 3111 - protein, 215 aa, Pantoea sp.
MRNLFLCPVLAALVLSGCSVGHTEYSRTAMQHVDMSVTGIPTILGLGTLGTSIPLTPEYSLTAAHVAKTAVQRVKSYHPYCDLAIIYHKNDANTLAKFRSGDIGDPVKMYGYSFISAMPVESTGVNLARTAIRNNWNKSPCIAMASNAGVVQGMSGGGVYNRDDTLSGVIVGYSDSIKNGRNNKVILKDVSLYIPYGQFKSWLESNLAQTPTRGV

SEQ ID NO: 3112 - protein, 215 aa, unknown
  environmental sample
MRNLFLSPVLAALVLSGCSVGHTEYSRTAMQHVDMSVTGIPTILGLGTLGTSIPLTPEYSLTAAHVAKTAVQRVKSYHPYCDLAIIYHKNDASTLTKFRSSDIGDPVKMYGYSFISAMPVESSGVNLARTAIRNKWNKSPCLAMASNAGVVQGMSGGGVYNRDDTLGGVIVGYSDSIRNGRNNKVILKDVSLYIPYGQFKNWLESNLAQTPTRGV

SEQ ID NO: 3113 - protein, 215 aa, Pantoea sp.
MRNLFLCPVLAALVLSGCSVGHTEYSRTAMQHVDMSVTGIPTILGFGTLGTSIPLTPEYSLTAAHVAKTAVQRVKSYHPYCDLAIIYHKNDATTLAKFRSGDIGDPVKMYGYSFISAMPVESTGVNLARTAIRNKWNKSPCIAMASNAGVVQGMSGGGVYNRDETLSGVIVGYSDAIKNGRNGKVILKDVSLYIPYGQFKSWLQSNLAPTPTRGV

SEQ ID NO: 3114 - protein, 233 aa, unknown
  environmental sample
MSKIFTRDFPTCLNKETIMKNLLLCPVLAALVLSGCSVGHTEYSRTAMQHVDMSVTGIPTILGLGTLGTSIPLTPEYSLTAAHVAKTAVQRVKSYHPYCDLAIIYHKNDASTLTKFRSSDIGDPVKMYGYSFISALPVESTGVNLARTAIRNNWNKSPCIAMASNAGVVQGMSGGGVYNRDDTLGGVIVGYSDSIKNGRNNKVILKDVSLYIPYGQFKSWLESNLAQTPTRGA

SEQ ID NO: 3115 - protein, 215 aa, unknown
  environmental sample
MRNLFLCPAFAALALTGCSVGHTEYSRTAMQHVDMSVTGIPTILGLGTLGTSIPLTPEYSLTAAHVAKTAVQRVKSYHPYCDLAIIYHKNDPGTLTRFRSSDIGDPIKMYGYSFISALPVESKGVNLARTTIRNGWNKSPCMAMASNAGVVQGMSGGGVYNSDETLGGVIVGYSDAIKNGRNGKVILKDVSLYIPYGQFKAWLQSNLAQTPTRGA

SEQ ID NO: 3116 - protein, 213 aa, Pantoea sp.
MQKQFLCLALMTLALSGCSVGHTEYSRTAMQHVDMSVTGIPTILGLGTLGTSIPLTPDYSLTAAHVAKFAVQRVKSYHPYCDLAIIYHKNPPNTLTQFRSTDIGDAVKMYGYSYISAMPVESKGVNLARTAIRNTWNKSPCIAMASNAGVVQGMSGGGVYNSDDTLGGVIVGYSDAIKNGRSGKVILKDVSLYIPYGQFKNWLQATLPATRKT

SEQ ID NO: 3117 - protein, 213 aa, unknown
  environmental sample
MQKQFLCLALMTLALSGCSVGHTEYSRTAMQHVDMSVTGIPTIFGLGTLGTSIPLTPDYSLTAAHVAKFAVQRVKSYHPYCDLAIIYHKNPPNTLTQFRSTDIGDAVKMYGYSYISAMPVESKGVNLARTAIRNTWNKSPCIAMASNAGVVQGMSGGGVYNSDDTLGGVIVGYSDAIKNGRSGKVILKDVSLYIPYGQFKNWLQATLPATRKT

SEQ ID NO: 3118 - protein, 213 aa, Pantoea sp.
MKKRFVSSALIALALSGCSVGHTEYSRTAMQHVDMSVTGIPTILGLGTLGTTIPLTPEYSLTAAHVAKFAVQRVKSYHPYCDLAIIYHKNPPDTLAHFRSTDIGDHVKMYGYSYISALPVESKGVNLARTAIRNLWNKSPCIAMASNAGVVQGMSGGGVFNSDDTIGGVIVGYSDSIKNGRSGKVILKDVSLYIPYGQFKNWLQATIPDTRKT

SEQ ID NO: 3119 - protein, 218 aa, unknown
  environmental sample
MKTSLLWPALAALALSGCSVGHTEYSRTAMQHVDMSVTGIPTVLGLGILGTTIPLTPEYSLTAAHVAKTAVQRVKAYHPYCDVAIIYHKNSPETLAKFRNGAIGEPIKMYGYSFISAMPVESSGVNLARTAITNKWNKKPCMAMASNAGVVQGMSGGAVYNADQTIGGVIVGYSHEISNVRSKKVILKDVSLYIPYGDFKTWLESNIGQTQKATPDHA

SEQ ID NO: 3120 - protein, 215 aa, Pantoea sp.
MRKRLLVPALAALGLCGCSVGHTEYSRTALSHVDMSFTGAPTILGLGTLGTTIPLTPEYSLTAAHVAKFALQRVKAYHPYCDVAIIYHKNSPYTLTKFRSSEMGEPIKMYGYSFVSALPVESEGVNLARTTIRNLWNKKPCMAVASNAGVVQGMSGGGVYNRDDTLAGVIVGYTSGIKNNRSGKVFLKDVSLYIPYGEFKTWLQSNINQAPGNSA

SEQ ID NO: 3121 - protein, 218 aa, Pantoea sp.
MRTSLLWPALAALALSGCSVGHTEYSRAALQHVDMSVTGIPTVLGLGVLGTTIPLTPEYSLTAAHVATTAVQRVKAYHPYCDVAIIYHKNDPSTLVKFRKSNIGEPIKMYGYSFISAMPVESSGVNLARTAINNHWNKKPCVAMATNAGVVQGMSGGAVYNSDQTMAGVIVGYSHRIDNIRSGQAVLKDVSLYIPYGEFRNWLESNIGQTPDSAPDHT

SEQ ID NO: 3122 - protein, 223 aa, unknown
  environmental sample
MKTAIMRTSLLWPALAALALSGCSVGHTEYSRTALQHVDMSVTGIPTVLGLGILGTTIPLTPEYSLTAAHVAKTAVQRVKAYHPYCDVAIIYHKNNPDTLAKFRSSAVGEPIKMYGYSFISAMPVESSGVNLARTAINNRWNKKPCMAMASDAGVVQGMSGGAVYNADQTISGVIVGYSHEIANVRSKKVILKDVSLYIPYGDFKRWLEANIGQTPQTAPGPA

SEQ ID NO: 3123 - protein, 213 aa, Pantoea sp.
MKITVLCPALFALALTGCSVGQTEYSKAALEHVDMSVTGVPTVLGLGVLGTTIPLTPEYSLTAAHVAKTSVQRVKAYHPYCDVAIIYHKNSPDTLARFRTSAPGEAIKMYGYSFISAMPVESSGVNLARTAITNRWNKKPCMAMASNAGVTQGMSGGAVYNSDETIAGVIVGYSHEIANRRSRKVILKDVSLYIPYGDFKRWLERNLSQAPVT

SEQ ID NO: 3124 - protein, 209 aa, unknown
  environmental sample
MKTLPLLSVVAALLLSGCSVGKYEYSREAMERVDMSVTGIPTILGLGTMGTSIPLTPEYSLTAAHVAKFAVQRVKAYHPYCDLAIIYHKNDLKTLPAFRAGKPGDAVKMFGYSFYSAMPVESSGVNLARTGIRNEWNKSPCIAMASNAGVVQGMSGGAVYNSDNTVAGVIIGYSREIKSRRRDQPVLKDVSLYIPYSDFSKWLARETTS

SEQ ID NO: 3125 - protein, 208 aa, Erwinia sp.
MKILTIMPALAALLLTGCSVGKYEYSSEALKRVDMSFTGVPTVLGLGTLGTSIPITPEYSLTAAHVAKFAVQRVKAYHPYCDLAIIYHKNDMKELPKFRSSGVGDPVKMYGFSFISAMPVESKGINLARTGIRNEWNKRPCVAMASNAGVVKGMSGGAVYNSDDSIGGVIVGFTSSIKNKRSGKEILKDVSLYIPYTDFKDWLAKSTS

SEQ ID NO: 3126 - protein, 209 aa, unknown
  environmental sample
MKILTFLPVLLTLLLSGCSVGKYEYSSEAMKHVDMNFTGIPTVLGVGMLGSSIPITPEYSLTAAHVAKYSVQRVKAYHPYCDIAVIYHKNDIKDLPKFRNSEIGDPIKMYGYSFISAMPVESTGVNLTRTGIRNSWNKRPCVAMASNAGVVKGMSGGAVFNNDDTIGGVIVGYTSKVKNRANSQSVLKDVSLYIPYANFKQWLEETTSS

SEQ ID NO: 3127 - protein, 88 aa, unknown
  environmental sample
MKMKLAIAALSLASLFSVGANAASLVSNEQAQGLQPMNQTISIGGRNGDQTHIRQVLSEKADAQGASHYRIIENNQDNTWHVTAELYK

SEQ ID NO: 3128 - protein, 88 aa, Pantoea sp.
MKMKLAIAALSLASLFSVGASAASLVSNEQAQGLQPMNQTISIGGRNGDQTHIRQVLSEKADAQGASHYRIIENNQDNTWHVTAELYK

SEQ ID NO: 3129 - protein, 88 aa, unknown
  environmental sample
MKTKLAIAALSLASLFSVGASAASLVSNEQAQGLQPMNQTISIGGRNGDQTHIRQVLSEKADAQGASHYRIIENNQDNTWHVTAELYK

SEQ ID NO: 3130 - protein, 88 aa, Pantoea sp.
MKTKLAIAVLSLASLFSVGASAASLVSNEQAQGLQSMNQTISIGGRNGDQTHVRQVLSEKADAQGASHYRIIENNQDNTWHVTAELYK

SEQ ID NO: 3131 - protein, 87 aa, Pantoea sp.
MKTKLAIAALSIALFSAGASAASLVSNEQAQGLQSMNQTISIAGRNGDQTHIRQVLSEKADAQGASHYRIIENNQDNTWHVTAELYK

SEQ ID NO: 3132 - protein, 90 aa, Pantoea sp.
MKTTFAIAVLSLASVFSVGASAASLVSNQQAQSQNLQPMNQTISVSGRDGDQTNIRQVLSEKADAQGASHYRIIENNQDDTYHVTAELYK

SEQ ID NO: 3133 - protein, 90 aa, unknown
  environmental sample
MKKTFAIAVLSLASVFSMGASAASLVSNQQAQSQNLQPMNQTISVSGRDGDQTNIRQVLSEKADAQGASHYRIIENNQDDTYHVTAELYK

SEQ ID NO: 3134 - protein, 88 aa, Pantoea sp.
MKTKLTIAIIGLASLLSVGAHAASLVSNDQAAGLQSMNQTVSVSGIDGDQTNIRQALSEKADAQGASHYRIIEANRDNTYHYTAELYK

SEQ ID NO: 3135 - protein, 90 aa, unknown
  environmental sample
MKIQLTIAALGVASLLSFGANAASMVTNQQAQDMNLQPLNQTISVSGINGDQTNIRQVLSEKADAQGAGHYRVIENNRDDTFHVTAELYK

SEQ ID NO: 3136 - protein, 90 aa, Pantoea sp.
MKTKLSIAVLSLASVLSFGASAASLITNEQADTMNLQPLNQTISVSGRDGDQNNIRQELSAKADAQGASHYRIIENNQNDTYHVTAELYK

SEQ ID NO: 3137 - protein, 88 aa, Pantoea sp.
MKTKSLIALAALTAALSFGASAASLVSNQQAETLQPLNQTISISGHDGDQTNIRQALSQKADAQGASHYRIIENNQDDTYHVTAELYK

SEQ ID NO: 3138 - protein, 88 aa, Pantoea sp.
MKTKLAIAVLGLASVLSFGASAASLVSNQQAEQLQSLNQTISVSGVDGDQTNVRQELSQKADAQGASHYRIIESNRGDTFHVTAELYK

SEQ ID NO: 3139 - protein, 87 aa, unknown
  environmental sample
MNIKTTIATVSLLSVMAFGASAAQLVTGDQTQNLQPAGTVTISGTAGSPMDYRAELSQKADKQGASAYKVIEARTGDNYHITAQLYK

SEQ ID NO: 3140 - protein, 87 aa, unknown
  environmental sample
MNIKTTIATVSLLSVIAFGASAAQLVTGDQAQNLQPAGTVTISGTAGSPMDYRAELSQKADEQGASAYKVIEARTGDNYHITAQLYK

SEQ ID NO: 3141 - protein, 87 aa, Pantoea sp.
MNIKTTIATVSLLSVMAFGASAAQLVTGDQTQNLQPAGTVSISGTAGAPMDYRAALSQKADEQGASAYKVIEARTGDNYHITAQLYK

SEQ ID NO: 3142 - protein, 87 aa, unknown
  environmental sample
MKIKTTIATVSLLSVMAFGASAAQLVTGEQTQNLQPAGTVTISGTAGAPMDYRAELSQKADEQGASAYKVIEARTGDNYHFTAQLYK

SEQ ID NO: 3143 - protein, 87 aa, Pantoea sp.
MKIKTTIATVSLLSVMAFGASAAQLVTGEQAQNLQPAGTVTISGTAGAPMDYRAELSQKADEQGASAYKVIEARTGDNYHFTAQLYK

SEQ ID NO: 3144 - protein, 87 aa, Pantoea sp.
MKIKTTIATVSLLSVIAFGAQAAQLITGDQAQNMQPAGTVTISGTAGSPMDYRAQLSQKADEQGASAYKVIEARTGDSYHFTAELYK

SEQ ID NO: 3145 - protein, 87 aa, unknown
  environmental sample
MNIKSTIATMSLLSVIAFGASAAQLVTADQTQNLQPAGTVSISGVAGSPIDYRAQLSQKADEQGASAYKIIEANTGDSYHITAQLYK

SEQ ID NO: 3146 - protein, 87 aa, Pantoea sp.
MKIKATIATASLLSLLTFGASAAQLVTAEQAQNMQPAGTVTISGTAGAPMDYRAQLSQKADEQGASAYKVIEARTGDNYHITAELYK

SEQ ID NO: 3147 - protein, 87 aa, Pantoea sp.
MNIKATIATVSLLSAMTFGASAAQLVTAEQAQNLQPAGTVSISGVAGSPIDYRAQLSQKADEQGASAYKIIEANTGDSYHLTAQLYK

SEQ ID NO: 3148 - protein, 88 aa, Pantoea sp.
MKIKTTIATASLLSLLAFGASAAQLVTEQQAQNLQPTGSTISISGTGGSPMDYRAELSQKADEQGASAYKVIEAKTGDSYHVTAELYK

SEQ ID NO: 3149 - protein, 88 aa, Pantoea sp.
MKIKTTIATATLLSLFAFGASAAQLVTEQQAQNLQPTGSTISISGTGGSPMDYRAELSQKADEQGASAYKVIEAKTGDSYHVTAELYK

SEQ ID NO: 3150 - protein, 88 aa, Pantoea sp.
MKIKTTIATATLLSLFAFGASAAQLVTDESAQNLQSTGQTITVSGTGGSPMDYRAQLSQKADEQGASAYKVIEARTGDSYHLTAELYK

SEQ ID NO: 3151 - protein, 88 aa, Pantoea sp.
MKIKTTLATAGLLSLFAFGASAAQLVTSESAQNLQPAGSTISISGTGGSPMDYREQLSQKADAQGASAYRVIEARTGDSYHVTAELYK

SEQ ID NO: 3152 - protein, 90 aa, Pantoea sp.
MKIKASIATLGLLSVMTFGASAAQLVTQQQVDEQNLQSVGSTITISGTAGSPMDYRAQLSEKANAQGASAYRVIEARTGDSYHVTAELYK

SEQ ID NO: 3153 - protein, 93 aa, Plautia sp.
MRRRIIKIKTTIATATLLSLFAFGASAAQLVTDESAQNLQSTGQTITVSVTGGSPMDYRAQLSQKADKQGASAYKVIEARTGDSYHLTAELYK

SEQ ID NO: 3154 - protein, 87 aa, Erwinia sp.
MKIKTTIATLSLLSLITFGASAAELVTTQQANNLQSAGTISVSGTGGAPIDIRQALSQKADAQGASAYRVIEARTGDSWHATAELYK

SEQ ID NO: 3155 - protein, 251 aa, unknown
  environmental sample
MKIQQTVLALGLATLLSGCQGLDNNALMQSGAQAYQAYTLSDDQVKQLSDQSCEQMDKENQIAPASSEYQQRLNKIAAALGDNINGVPANYKVYQTKDVNAWAMANGCIRVYSGLMDMMTDNEVEGVLGHEMGHVALGHTRKAMQLAYATTAARTAAASVGGVIGSLSQSQLGEMGEKLVNAQFSQTQETQADDYSYDLMKKRNIDPMGLATSFEKLAKLEQGRQSSMFDSHPASEARAQHIRERIAADGK

SEQ ID NO: 3156 - protein, 251 aa, Pantoea sp.
MKIQKTVLALGLATLLSGCQGLDNNALMQSGAQAYQAYTLSDDQVKQLSDKSCDQMDKENQIAPADSQYQQRLNKIAAALGDNINGVPANYKVYQTKDVNAWAMANGCIRVYSGLMDMMTDNEVEGVLGHEMGHVALGHTRKAMQLAYATTAARTAAASVGGVIGSLSQSQLGELGEKLVNAQFSQSQESQADDYSYDLMKKRNINPMGLVTSFEKLAKLEQGRQSSMFDSHPASEARAQHIRDRIAADAK

SEQ ID NO: 3157 - protein, 251 aa, Pantoea sp.
MKIQKTVLALGMIALLSGCEGMNNNGLLQSGAQAFQAYTLSDAQVKQLSDQSCAQMDKDNQVAPANSEYQQRLNKIAAALGDNINGTPANYKVYQTKDVNAWAMANGCIRVYSGLMDMMNDNEVEAVLGHEMGHVALGHTRKAMQVAFTTTAARTAAASVGGIIGSLSQSQLGDMGEKLVNAQFSQTQETQADDYSYDLLKKRGIDPVGLATSFEKLAKLEQGRQSSMFDSHPDSEARAQHIRDRIAADSK

SEQ ID NO: 3158 - protein, 251 aa, unknown
  environmental sample
MKIRAMVVALGMVSLLSGCEGMDNNALLQSGAQAFQAYSLNDAQVKELSDQSCAQMDKENQLAPANSSYQQRLNKIAAALGDNINGVPANYKVYLTKDVNAWAMANGCIRVYSGLMDMMSDNEVEGVLGHEMGHVALGHTRKAMQVAFATTAARNAAASVGGVIGSLSQSQLGEMGEKLVNAQFSQTQESQADDYSYDLLKKRGINPLGLATSFEKLAKLDQGRQSSMFDSHPDSESRAQHIRDRIAADGK

SEQ ID NO: 3159 - protein, 251 aa, unknown
  environmental sample
MKIHKTALALGLVALLSGCEGVNSNGLLQSGAQAFQAYTLSDAQVKQLSDQSCAQMDKENQVAPADSEYQQRLNKIAAALGDNINGIPANYKVYQTKDVNAWAMANGCIRVYSGLMDMMTDNEVEAVLGHEMGHVALGHTRKAMQVAFTTTAARTAAASAGGIIGSLSQSQLGDMGEKLVNAQFSQTQETQADDYSYNLLKKRGIDPVGLATSFEKLAKLEQGRQSSMFDSHPDSEARAQHIRDRIAADGK

SEQ ID NO: 3160 - protein, 252 aa, Pantoea sp.
MTIKTGIMAISLAALLSGCQGMDNNALLQSGAQAFQAYTLNDAQVKQLSDQSCAQMDKENQLAPADSTYQQRLNKIAAALGDNINGTPANYRVYVTKDVNAWAMANGCIRVYSGLMDMMDDNEVEGVLGHEMGHVALGHTRKAMQVAFGTTAARTAAASVGGVIGSLSQSQLGDLGEKLVNAQFSQTQESQADDYSYDLLKKRGIDPMGLATSFEKLAKMQQGQQSSLFDSHPDSAARAQHIRERIAADAGK

SEQ ID NO: 3161 - protein, 250 aa, Erwinia sp.
MKLKTAALAFSVATLLAGCQNLDTSALMQSGAQAYQAATLSDAQVKELSDKSCQQMDSEAQIAPASSTYAKRLAKISAALGDNINGTPANYKVYVTKDVNAWAMANGCIRVYSGLMDMMTDNEVEGVLGHEMGHVALGHTRKAMQVAYATTAARSAAGAAGGIAASLSQSQLGDLGEKLVNAQFSQTQESQADDYSFDLLKKRGINPNGLVTSFEKLAKLEGGHQSSMFDSHPASAARAEHIKERIAAGK

SEQ ID NO: 3162 - protein, 250 aa, Serratia sp.
MKIRTSLIALSITTLLGGCQNLNTDTLMQSGAQAFQAATLSDADVKALSDKSCAEMDSQAQIAPADSTYTKRLNKIAAALGDNINGTPANYKVYLTKDVNAWAMANGCIRVYSGLMDMMNDNEVEGVLGHEMGHVALGHTRKAMQVAYGTVALRTAAASTGGIAASLSQSQLADLGEKLVNAQFSQKQESEADDYSFDLLKKRGIDPNGLVTSFEKLAKMEGDRKSSMFDSHPASEARAQHIRERIAAGK

SEQ ID NO: 3163 - protein, 250 aa, Erwinia sp.
MNKRISCIALALAGLLSGCQNFDSNALMQSGTQAWQAATLSDVQVKELSDKSCQQMDGEAQIAPDSSPYAQRLKKIAAALGDNINGTPANYKVYLTKDVNAWAMANGCIRVYSGLMDLMSDNEVEGVLGHEMGHVALGHSRKAMQLAWATTAARSAAASVGGVTASLSQSELGDLGEKLVNAQFSQSQESQADDYSFDLLKKRNINQQGLVTSFEKLAKMEGSHASSLFDSHPASQARADHIRQRIAAEK

SEQ ID NO: 3164 - protein, 250 aa, unknown
  environmental sample
MKIRTSVMALSVATLLSGCQNFDTNSLMQSGAQAYQAATLSDAQVKELSVQSCQQMDSEAQIAPASSEYTKRLDKIATSLGDNINGTPANYKVYLNKDVNAWAMANGCIRVYSGLMDMMTDNEVEGVLGHEMGHVALGHTRKAMQVAYATTAARTAASAAGGIAASLSQSQLGDLGAQLVNAQFSQTQESQADDYSFDLMKQRKIDPNGLVTSFEKLAKLEGSHQSSMFDTHPSSASRAEHIKARIAAEK

SEQ ID NO: 3165 - protein, 252 aa, Klebsiella sp.
MKIRPALLALGMTTLLAGCQNMDSNGFLSSGAEAFQAYTLSDAQVIALSDDACKQMDSKATIAPASSEYSQRVNKIAAALGDNINGQPVNYKVYVTKDVNAFAMANGCIRVYSGLMDMMTDNEVEAVVGHEMGHVALGHVKKGMQVALGTNAVRAAAASAGGVVGSLSQSQLGALGEKLVNSQFSQRQESEADDYSYDLLRKRGINPVGLATSFEKLAKMDQGRQSSMFDDHPASEARAQHIRDRMAADGIK

SEQ ID NO: 3166 - protein, 250 aa, Yersinia sp.
MNIRTSLMALSITALLSGCQNMNTEGLMQSGAQAFQAATLSDTDVRTLSDKSCAEMDQKAQIAPADSEYSKRLAKISAALGDNINGTPANYKVYVTKDVNAWAMANGCIRVYSGLMDMMTDNEVEGVLGHEMGHVALGHTRKAMQVAYGTIALRTAASSAGGIATSLSQSQLADIGEKLVNAQFSQKQESEADDYSFELLKKRGIDPNGLVTSFEKLAKMEGGRGSSLFDDHPASQARADHIRERITSGQ

SEQ ID NO: 3167 - protein, 252 aa, unknown
  environmental sample
MKMRAIGLAVGTTLLLSGCQNMDSNGLMTSGAEAFQAYSLSDAQVKALSDEACKDMDGKATLAPANSTYTQRLNKIASALGDNINGQPVNYKVYMAKDVNAFAMANGCIRVYSGLMDMMTDNEVEAVIGHEMGHVALGHVKKGMQVALGTNAVRAAAASAGGIVGSLSQSQLGDVGEKLVNSQFSQRQESEADDYSYDLLRKRGINPSGLATSFEKLAKLEEGRQSSMFDDHPASEERAQHIRDRMAADGIK

SEQ ID NO: 3168 - protein, 250 aa, Rahnella sp.
MKFHPLLLSLFTASLVSGCATVNTDTLMQSGAQAYQAYTLSDADVKTLSVQSCEEMDKKAQIAPDSSEYAQRLKKISAALGDSINGTPANYKVYLTKDVNAWAMANGCIRVYSGLMDIMNDNEVEGVLGHEMGHVALGHTRKAMQVAYSATAARSAISSLGGVSATLSQSQLADLGEKYVNAQFSQKQESEADDYSFDLLKKRGIDPTGLATSFEKLAKLDQGSSIGWFDDHPSSEARAKHIRERIAAGK

SEQ ID NO: 3169 - protein, 252 aa, Enterobacter sp.
MKIRSTLLAFGIAATLTGCQNMDSNALLSSGAEAFQAYSLSDEQVKTLSDQACKEMDAKATISPASSEYSKRLSKIAAALGDNINGQPVNYKVYETKDVNAFAMANGCIRVYSGLMDLMNDNEVEAVIGHEMGHVALGHVKKGMQVALGTNAVRAAAASAGGIVGSLSQSQLGDLGEKLVNSQFSQRQESEADDYSYDLLRKRGINPSGLATSFEKLAKLEAGRQSSMFDDHPASEARAQHIRDRMKADGIK

SEQ ID NO: 3170 - protein, 250 aa, Xenorhabdus sp.
MKIKALVAVAVSAVILTGCKNIDQGMLAQSGMQLFQAATLSDSDVKQLSDQSCKDMDAQNKVAPASSQYTKRLNKIAKALGNEVNGTQVNYKVYLTKDVNAWAMANGCVRVYSGLMDMMNDNEVEGVLGHEMGHVALGHTRKAMQVAYAAVAARTAAASAGGVAAQLSDSQLAELGEKLINSQFSQHQESQADDSSYDLLKKRNIKTEGLATSFEKLAKLGSGETSMFDSHPPSQARAQHVRDRIAADKK

SEQ ID NO: 3171 - protein, 68 aa, unknown
  environmental sample
MKTFVIATLLGLFLSPPALASNADCAQQIRSHSSEAASGYIYVNRLDAPQKNPVNAPARAAEKSSAHW

SEQ ID NO: 3172 - protein, 68 aa, unknown
  environmental sample
MKTFVIATLLGLFLSPPALASNADCAQQIRSHSSEAASGYIYINRLDAPQKNPVNAPARAAEKSSAHW

SEQ ID NO: 3173 - protein, 68 aa, Pantoea sp.
MKTFVIATLLGLFLSPPALASYADCAQQMRSHSSEAASGYVYVNRLDTPERNPVNAPARTAEKSSAHW

SEQ ID NO: 3174 - protein, 68 aa, unknown
  environmental sample
MKTFVIATLLGLFLSPTALASYADCAQQMRSHSSEAASGYVYVNRLDTPERNPVNAPARTAEKSSAHW

SEQ ID NO: 3175 - protein, 68 aa, Pantoea sp.
MKTFVIATLLGLFLSPPALASHADCAQQMRSHSSEAASGYVYVNRLDTPERNPVNAPASAAEKASAFW

SEQ ID NO: 3176 - protein, 68 aa, Pantoea sp.
MKTFVIATFLGLFLSPPALASHADCAQQIRSHSSEAASGYVYVNRLDRPERNPVSAPVSPAEKSAARW

SEQ ID NO: 3177 - protein, 67 aa, unknown
  environmental sample
MKRYVIATLLGLFLSLPALASNADCAQQMRSHSSKAASGYVYVNRLDAPERSPVSTPARPAERFAAP

SEQ ID NO: 3178 - protein, 67 aa, Pantoea sp.
MKRYVIATLLGLFLSLPALASNADCAQQMRSHSSKAAEGYVYVNRLDAPESNPISAPARLSERFTAR

SEQ ID NO: 3179 - protein, 306 aa, Pantoea sp.
MRISLFSGTPTVIGHDNRGLTVRDILYNRHPGLPEATDERITRHRYDARGFLTQSADPRLHERGLANFSSVTDAAGRVLRARGADNGTIVMLNDAAGRAFMTVSNIRTTEDDTEDLSQAVTRNWQYEGAILPGRPVSMMEQVTGKTARITARFVYAGNAGEEKALNLAGSCVSHYDTAGLVQTDSIALTGVPLSVICRLPKDADNPDVMTDWQGDDASLWNDLLDSESQATLTTADATGAVLTTTDARGNLQRVAYDVAGLLSGSWLTVKGGREQVIVASLTYSAAGQKLREAHGNGVVTSYAYDA

SEQ ID NO: 3180 - protein, 323 aa, unknown
  environmental sample
MRISLFSGTPTVIGHDNRGLTVRDILYNRHPGLPEATDERITRHRYDARGFLTQSADPRLHERGLANFSSVTDAAGRVLRARGADNGTIVMLNDAAGRAFMTVSNIRTTEDDTEDLSQAVTRNWQYEGAILPGRPVSMMEQVTGKTARITARFVYAGNAGEEKALNLAGSCVSHYDTAGLVQTDSIALTGVPLSVICRLPKDADNPDVMTDWQGDDASLWNDLLDSESQATLTTADATGAVLTTTDARGNLQRVAYDVAGLLSGSWLTVKGGREQVIVASLTYSAAGQKLRDANGKGVVTSYAYDARTQRLTGIKTARPAGHA

SEQ ID NO: 3181 - protein, 249 aa, Pantoea sp.
MRISLFSGTPTVIGHDNRGLTVRDILYNRHPGLPEATDERITRHRYDARGFLTQSADPRLHERGLANFSSVTDAAGRVLRARGADNGTIVMLNDAAGRAFMTVSNIRTTEDDTEDLSQAVTRNWQYEGAILPGRPVSMMEQVTGKTARITARFVYAGNAGEEKALNLAGSCVSHYDTAGLVQTDSIALTGVPLSVICRLPKDADNPDVMTDWQGDDASLWNDLLDSESQATLTTADATGAVLTTTDARG

SEQ ID NO: 3182 - protein, 295 aa, Yersinia sp.
MKTSLFSKTPPVTVLDNRGLTVRDIAYHRHPDSPDVISERITHHQYDARGFLTQSADPRLHGAGLMNFSYLTDLTGRILRTQGADNGTTVSLNDAAGRPFISASNISTSDDGTEDRGQAMTRTWQYEEASLPGRLVSVTEQVTGKATRITERFVYAANTDAEKSLNLAGACVSHYDTAGLVQPDSIALTGVPLSVTRRLMKSADNPDAVADWQGADASAWNDQLDGETHTTLTTADATGAVLTTTDAKGNLQRMAYDVAGLLSGSWLTLKDGTEQVIVKSLTYSAAGQKLREEHG

SEQ ID NO: 3183 - protein, 119 aa, Pantoea sp.
MNYFRIGSLAGVLLLCGCQAPTPDQARQQQPVFQGQSTRTVPQLSDCIYRGWSTTSVIARDNTTHTQPDGSEISVFTWEDSIFADVSPRRKGSDVKYFTTFRMAPQVMADRQAIVERCL

SEQ ID NO: 3184 - protein, 119 aa, Pantoea sp.
MNYFRIGSLAGVLLLCGCQAPTPDQARQQQPVFQGQSTRTVPQLSDCIYRGWSTTSVIARDNTTHTQPEGSEISVFTWEDSIFADVSPRRKGSDVKYFTTFRMAPQVMADRQAIVERCL

SEQ ID NO: 3185 - protein, 119 aa, unknown
  environmental sample
MNCFRIGSLAGVLLLCGCQAPTPDQARLQQPVFQGQSTRTVPQLSDCIYRGWSTTSVIARDNTTHTQPNGSEISVFTWEDSIFADVSPRRKGAEVKYFTTFRMAPQVMADRQAIVERCL

SEQ ID NO: 3186 - protein, 119 aa, Pantoea sp.
MNCFRIGSLAGVLLLCGCQAPTPDQARLQQPVFQSQSTRTVPQLSDCIYRGWSTTSVIARDNTTHTQPNGSEISVFTWEDSIFADVSPRRKGAEVKYFTTFRMAPQVMADRQAIVERCL

SEQ ID NO: 3187 - protein, 119 aa, Pantoea sp.
MNYVRIGSLAGVLLLCGCQAPTPDQARLQQPVFQGQSARTVPQLSDCIYRGWSTTSVIARDNTTHTQPNGSEISVFTWEDSIFADVSPRRKGADVKYFTTFRMSPEVMADRQAIVERCL

SEQ ID NO: 3188 - protein, 119 aa, Pantoea sp.
MNYYRIGSLAGVLLLCGCQAPTPDQARLQPPVFQGQSTRTVPQLSDCIYRGWSTTRVIARDNTTHTQPAGSEISVFTWEDSIFADVSPHRKGAEVKYFTTFRMSPDVMADRQAIVERCL

SEQ ID NO: 3189 - protein, 119 aa, unknown
  environmental sample
MNYYRIGSLAGVLLLCGCQAPTSDQARLQPPVFQGQSTRTVPQLSDCIYRGWSTTSVIARDNTTHTQPNGNEISVFTWEDSIFADISPHRKGAEVKYFTTFRMAPQVIADRQAIVQRCL

SEQ ID NO: 3190 - protein, 119 aa, Pantoea sp.
MNTFRIGSLTGVLLLCSCQAPTPDQARLQEPLFQGQSTRTVPQLSDCIYRGWSTTSVVARDDTTHTRPGGSAISVFTWEDSIFADVSPHGRGAEVKYFTTFRMAPQVMADRQAIVKRCL

SEQ ID NO: 3191 - protein, 119 aa, Pantoea sp.
MTHFRIGSLFGVLLICGCQAPTPEQARLNQPLFQGQSARTVPQLSDCIYRGWSTTEVIARDNTTHTQPQGEQITILTWEDSIFADVTPQPQGAEVKFFTTFNMAPQVMADRQAIVRRCL

SEQ ID NO: 3192 - protein, 119 aa, unknown
  environmental sample
MTHFSIGSLFGVLLICGCQAPTPEQARLNQPLFQGQSARTVPQLSDCIYRGWSTTEVIARDNTTHTQPQGEQITILTWEDSIFADVTPQPQGAEVKFFTTFNMAPQVMADRQAIVRRCL

SEQ ID NO: 3193 - protein, 88 aa, Pantoea sp.
MNYFRIDSLAGVLLLCGCQAPTPDQARQQQPVFQGQSTRTVPQLSDCIYRGWSTTSVIARDNTTHTQPDGSEISVFTWEDSIFADVSP

SEQ ID NO: 3194 - protein, 132 aa, Pantoea sp.
MKLVHGLALAVFSLGISASALAEDTCAKQPSDGALFQCTVQQKKLAEDDLNKEYQTAKKRIVQMYGTQKKLADDYVATLVDTQRNWLKYRDGQCKLEAFAAEDGSNANAVATNLCVIRIDKERTAILKQLPY

SEQ ID NO: 3195 - protein, 132 aa, unknown
  environmental sample
MKRLHKLALIAVSLCISASALAEDTCAKKPSDGALFQCTVQQKKLAEDDLDKEYQTAKKRIVQMYGTQKKLADDYVATLVDTQRSWLSYRDGQCKLEAFAAEEGSNANAVATNLCVIRIDKERTAILKQLPY

SEQ ID NO: 3196 - protein, 132 aa, unknown
  environmental sample
MKRLHEVALIAVSLCISASAFAEDTCAKQPSDGALFQCTVQQKKLAEDDLNKAYQTAKKRIVQMYGTQKKLADDYVATLVDTQRSWLRYRDGQCKLEAFAAEEGSNANAVATSLCVIRIDKERTAILKQLPY

SEQ ID NO: 3197 - protein, 140 aa, unknown
  environmental sample
MVQTAEKNMKRLHKLALIAVSLGISASALAEEPCAKQPSDGALFQCTVQQKKLAEDELNKEYQTAKKRIVQMYGTQKKLADDYVATLVDTQRSWLRYRDGQCKLEAFAAEEGSNANAVATNLCVIRIDKERTAILKQLPY

SEQ ID NO: 3198 - protein, 140 aa, unknown
  environmental sample
MVQTAEKNMKRLHKLALITVSLCISASALAEDTCAKQPSDGALFQCTVQQKKLAEDDLNKEYQTAKKRIVKMYGTQKKLADDYVATLVDTQRNWLKYRDGQCKLEAFAAEEGSNANAVATNLCVIRIDKERTAILKQLPY

SEQ ID NO: 3199 - protein, 140 aa, unknown
  environmental sample
MVQTAEKNMKRLHKLALITVSLCISASALAEDTCAKQPSDGALFQCTVQQKKLAEDDLNKEYQTAKKRIVQMYGTQKKLADDYVGTLVDTQRNWLKYRDGQCKLEAFAAEDGSNANAVATNLCVIRIDKERTAILKQLPY

SEQ ID NO: 3200 - protein, 140 aa, unknown
  environmental sample
MVQTAEKNMKRLYKLALITVSLGISASALAEDTCAKQPSDGALFQCTVQQKKLAEDDLNKEYQTAKKRIVQMYGTQKKLADDYVTTLVDTQRNWLKYRDGQCKLEAFAAEEGSNANAVATNLCVIRIDKERTAILKQLPY

SEQ ID NO: 3201 - protein, 132 aa, unknown
  environmental sample
MKKIYEVALIAFSISMSASALAESPCTKQPSDGALFQCTVQQKKLAEDDLNKEYQTAKKRIVQMYGTQKKLADDYVATLVDTQRNWLKYRDGQCRLEAFAAEEVSNANAVATKLCVIRINKERTAILKQLPY

SEQ ID NO: 3202 - protein, 132 aa, unknown
  environmental sample
MKKIYEVALIAFSISMSASALAESPCTKQPSDGALFQCTVQQKKLAEDDLNKEYQTAKKRIVQMYGTQKKLADDYVATLVDTQRNWLKYRDGQCRLEAFAAEEVSNANAVATKLCDIRINKERTAILKQLPY

SEQ ID NO: 3203 - protein, 132 aa, Pantoea sp.
MKRISKLVLIGVSLSVSASAIADETCAKQPSDGTLFQCTVQQKTLAEDDLNKAYQTAKKRIVQMYGTQKKLADDYVATLVDTQRNWLKYRDGQCRLEAFAAEEGSNASAVATNLCVIRIDKERIALLKQLPY

SEQ ID NO: 3204 - protein, 105 aa, Pantoea sp.
MKLVHGLALAVFSLCISASALAEDTCAKQPSDGALFQCTVQQKKLAEDELNKEYQTAKKRIVQMYGTQKKLADDYVATLVDTQRSWLRYRDGQCKLEAFAAEEGS

SEQ ID NO: 3205 - protein, 132 aa, Erwinia sp.
MKLGYGCIVTVLALSVSASAFAEDICSNEPSDGALYQCTVQQKKLAENDLNKEYAVAKKRIVQMYGAQKQLADEYVATVVDTQRSWLKYRDGQCKLEAFAAEEGSNANAVAVNLCIIRIDKERTEMIRQMPY

SEQ ID NO: 3206 - protein, 132 aa, Ewingella sp.
MKLGYGLLVTILALGGMTSAFADDNCSKQPSDGALYQCTVQQKKSAEDDLNKEYAAAKKRIVQMYGSQKQLGDQYVAIVVDTQRSWLKYRDGQCKLEAFAAEEGSNANAVAVNLCITRIDKERTDMLKQMPY

SEQ ID NO: 3207 - protein, 101 aa, unknown
  environmental sample
MSKDTSSEHLRAELKNLADTLEEVLSSSTEKSKGELDKLRNKARVALDSSRERLGESSERIAATTREAAQKAEGYVRENPWHGVGIGAAIGVALGILISRR

SEQ ID NO: 3208 - protein, 101 aa, Pantoea sp.
MSKDTSSEHLRAELKNLADTLEEVLSSSTEKSKGELDKLRNKARVALDSSRERLGESGERLAATTREAAQKAEGYVRENPWHGVGIGAAIGVALGMLISRR

SEQ ID NO: 3209 - protein, 101 aa, Pantoea sp.
MSKDTSSEHLRAELKNLADTLEEVLSSSTEKSKGELDKLRSKARDALDSSRERLGESSERIAATTREAAQRAEGYVRENPWHGVGIGAAIGVALGMLISRR

SEQ ID NO: 3210 - protein, 107 aa, Pantoea sp.
MLKEYFMSKDTSSEHLRAELKNLADTLEEVLSSSTEKSKGELDKLRNKARVALDSSRERLGESSERIAATTREAAQKAEGYVRENPWHGVGIGAAIGVALGMLISRR

SEQ ID NO: 3211 - protein, 101 aa, unknown
  environmental sample
MSKDTSSEYLRAELKNLADTLEEVLSSGTEKSKGELDKLRHKARVALDSSRERLGESGERLAATTREAAQKADGYVRDNPWHGVGIGAAIGVAIGMLISRR

SEQ ID NO: 3212 - protein, 101 aa, Pantoea sp.
MSKDTSSEHLRAELKNLADTLEEVLSSTTDKSKGELDKLRQKARVALDSSREKLGDSGEYLAQTTREAAQKADGYVRDNPWHGVGIGAAIGVAIGMLISRR

SEQ ID NO: 3213 - protein, 107 aa, Pantoea sp.
MLKEYFMSKDTSSEYLRAELKNLADTLEEVLSSGTEKSKGELDKLRHKARVALDSSRERLGESGERLAATTREAAQKADGYVRDNPWHGVGIGAAIGVAIGMLISRR

SEQ ID NO: 3214 - protein, 101 aa, Pantoea sp.
MSKESSSEHLRAELKNLADTLEEVLSSSSEKSKTELDKLRHKAQAALNSSRERLGDSGERLAQTTREAAAKADDYVRENPWHGVGIGAAIGVALGILLSRR

SEQ ID NO: 3215 - protein, 101 aa, Pantoea sp.
MAKDTTSEHLRAELKNLADTLEEVLSSSADKSKSELDKLRHKARGAIESSRERLGESGERIAQTTREAAEKADVYVRENPWHGVGIGAAVGVLIGILISRR

SEQ ID NO: 3216 - protein, 101 aa, Pantoea sp.
MAKDTTSEHLRAELKNLADTLEEVLSSTGEKSKTELDKLRQKAREALDTSRERLGESGERLAQSTREAAHKADDYVRENPWHGVGIGAAVGVVIGILLSRR

SEQ ID NO: 3217 - protein, 101 aa, unknown
  environmental sample
MSKDTNSEHLRAELKNLADTLEEVLSTTGEKSKTELDKLRAKARAALDESRHRLGESGERIAQGTREAAGRADEYVRENPWHGVGIGAAVGVVLGVLLTRR

SEQ ID NO: 3218 - protein, 101 aa, Pantoea sp.
MAKDSTSEHLRAELKNLADTLEEVLSSTGDKSKTELDKLRQKAREALDTSRERLGESGERLAQSTREAAHKADDYVRENPWHGVGIGAAVGVVIGILLSRR

SEQ ID NO: 3219 - protein, 105 aa, Plautia sp.
MENTMAKDTTSEHLRAELKNLADTLEEVLSSSADKSKSELDKLRHKARGAIESSRERLGESGERIAQTTREAAEKVDVYVRENPWHGVGIGAAVGVLIGILISRR

SEQ ID NO: 3220 - protein, 101 aa, Pantoea sp.
MSKDTTSEHLRAELKNLADTLEEVLSSSTDKSKTELDKLRTKARAALEDSRQRLGDSGEKLVQTTREAAGRADEYVQDNPWHGVGIGAALGVALGILIARR

SEQ ID NO: 3221 - protein, 101 aa, Cedecea sp.
MSKDTTSEHLRAELKSLADTLEEVLSASTDKSKTELDKLRTKAEKALKESRSRLGETSEAIAQQTREAAAKADDYVRENPWTGVGIGAAVGVVLGVLLARR

SEQ ID NO: 3222 - protein, 101 aa, Enterobacter sp.
MSKDTTSEHLRAELKSLADTLEEVLSASTDKSKTELDKLRAKAEKTLKESRDRLGETSEAIAKQTREAAAKADDYVRENPWTGVGIGAAVGVVLGVLLARR

SEQ ID NO: 3223 - protein, 101 aa, unknown
  environmental sample
MSKDTTSEHLRAELKNLADTLEEVLSSSTEKSKTELDKLRSKAQSALKDTRARLGDSGDRIAQTTREAAERTDVYVRDNPWTSVGIGAAVGVVLGVLLTRR

SEQ ID NO: 3224 - protein, 101 aa, unknown
  environmental sample
MSKDTTSEHLRAELKSLADTLEEVLSASSDKSKSELEKLRGKAEKALKESRSRLGDTSDVIAKQTREAAAKADDYVRENPWTGVGIGAAIGVVLGVLMTRR

SEQ ID NO: 3225 - protein, 101 aa, unknown
  environmental sample
MSKDTTSEHLRAELKSLADTLEEVLSTSTDRSKSEMEKLRGKAEKALKESRHRLGETSDVLAKQTREAAAKADDYVRENPWTGVGIGAAIGVVLGVLLTRR

SEQ ID NO: 3226 - protein, 101 aa, Citrobacter sp.
MSKDNATEHLRAELKSLADTLEEVLSSSGDKSKEELSKIRSKAERALKESRNRLGETSDVIAKQTREAAARADNYVRENPWTGVGIGAAVGVVLGVLLSRR

SEQ ID NO: 3227 - protein, 101 aa, Enterobacter sp.
MSKDTTSEHLRAELKSLADTLEEVLNSSTDKSKEELSKLRSKAESALKDSRYRLGETGDALAKQTREAAARADEYVRDNPWTGVGIGAAVGVVLGVLLTRR

SEQ ID NO: 3228 - protein, 189 aa, unknown
  environmental sample
MKLKLFLFAAAGLTVAVPSLTQAATTSGTINATLTLTTGCLVNGQSATAGVNFGTLNFGSSAATFDTLNATLVGAAGNGIFVRCTTGQDYNVVVTSSNAAPATIYGTASTSPRYLILGSNNAQGIAYTLYSDASFTTAIANNTPIAASGTTDPTLGTNYAIYGRVVGGGFNPLIPAGTYTDTINVAVNY

SEQ ID NO: 3229 - protein, 189 aa, Pantoea sp.
MKLKLFLCAAAGLTVAMTPLTQAATTSGTINATLTLTTGCLVNGQSATAGVNFGTLNFGSSAATFDTLNATLVGAAGNGIFVRCTTGQDYNVVVTSSNTAPATIYGTASASPRYLVLGSDNAQGIAYTLYSDASFTTAIANNTPIAASGTTDPTLGTNYAIYGRVVGGGFNPLIPAGTYTDTINVAVNY

SEQ ID NO: 3230 - protein, 189 aa, Pantoea sp.
MKLKLFLFAAAGLTVAVPSLTQAATTSGTINATLTLTTGCLVNGQSATAGVNFGTLNFGSSAATFDTLNATLVGAAGNGIFVRCTTGQDYNVVVTSSNAAPATIYGTASTSPRYLILGSNNAQGIAYTLYSDASFTTAIANNTPIASSGTTDPTRGTNYAIYGRVVGGGFNPLIPAGTYTDTINVAVNY

SEQ ID NO: 3231 - protein, 189 aa, unknown
  environmental sample
MKLKLFLLAAAGITTALPSLTLAATTSGTINATLTLTTGCLVNGQSATAGVNFGTLNFGSSAATFDTLNATLVGAAGNGIFVRCTTGQDYNVVVTSSNTAPATVYGTASTSPRYLVLGSDNAQGIAYTLYSDASFTTAIANNTPIAASGTTDPTLGTNYAIYGRVVGGGFNPLIPAGTYTDTINVAVNY

SEQ ID NO: 3232 - protein, 189 aa, Pantoea sp.
MKFKLFLLAAAGISTALPSLTLAATTSGTINATLTLTTGCLVNGQSATAGVNFGTLNFGSSAATFDTLNATLVGAAGNGIFVRCTTGQDYNVVVTSSNTAPATVYGTASTSPRYLVLGSDNAQGIAYTLYSDASFTTAIANNTPIAASGTTDPTLGTNYAIYGRVIGGGFNPLIPAGTYTDTINVAVNY

SEQ ID NO: 3233 - protein, 189 aa, Pantoea sp.
MKFKLFLFAAAGLTSALPAVTFAATTTGTINATLTLTTGCLVNGQSATTGVNFGTLNFGSSAATFDTLNATLVGASGNGIYVRCTTGQTFNVQVTSSNAAPATIYGTVSGQPRYLILGSNNTQGIAYTLYSDAAFTTAIANNTNIAPSGTTDPTLGTNYAIYGRVVGGGFNPLIPAGTYTDTINVAVNY

SEQ ID NO: 3234 - protein, 189 aa, unknown
  environmental sample
MKLKLFLVASSLSAALAPHAVFAATTTGTINATLTLTTGCLVNGQSATAGVNFGTLNFGSSAATFDTLNATLVGAAGNGIFVRCTTGQTFNVQVTSSNAAPATVYGTVSGQPRYLILGSNNTQGIAYTLYSDAAFTTAIANNTNIAASGTTDPTLGTNYAIYGQVVGGGFNPLIPAGTYTDTINVAVNY

SEQ ID NO: 3235 - protein, 189 aa, unknown
  environmental sample
MKLKLFLLATSLSAALAPATVFAATTTGTINATLTLTTGCLVNGQSATSGVNFGTLNFGSSAATFDTLNATLVGASGNGIFVRCTTGQTFNVQVTSSNPAPATIYGTVSGQPRYLILGSNNTQGIAYTLYSDAAFTTAIANNTNIAASGTTDPTLGTNYAIYGRVVGGGFNPLIPAGTYTDTINVAVNY

SEQ ID NO: 3236 - protein, 188 aa, unknown
  environmental sample
MKFKLFLFVVGLTTALPSATFAATTTGAINATLTLTTGCLVNGQSATTGVNFGSLNFGSSAATFDTLNATLVGAAGNGIYVRCTTGQTFNVQVTSSNAAPGTVYGTVSSAPRYLVLGADNTQGIAYTLYSDASFSTAIANNTNIAPSGTTDPTLGTNYAIYGRVVGGGFNPVIPAGTYTDTINVAVNY

SEQ ID NO: 3237 - protein, 189 aa, unknown
  environmental sample
MKLKLFLLATSLSAALAPATVFAATTTGTINATLTLTTGCLVNGQFATSGVNFGTLNFGSSAATFDTLNATLVGASGNGIFVRCTTGQTFNVQVTSSNPAPATIYGTVSGQPRYLILGSNNTQGIAYTLYSDAAFTTAIANNTNIAASGTTDPTLGTNYAIYGRVVGGGFNPLIPAGTYTDTINVAVNY

SEQ ID NO: 3238 - protein, 190 aa, Pantoea sp.
MVMKFKLFLFVVGLTTALPSATFAATTTGAINATLTLTTGCLVNGQSATTGVNFGSLNFGSSAATFDTLNATLVGAAGNGIYVRCTTGQTFNVQVTSSNAAPGTVYGTVSSAPRYLVLGADNTQGIAYTLYSDASFSTAIANNTNIAPSGTTDPTLGTNYAIYGRVVGGGFNPVIPAGTYTDTINVAVNY

SEQ ID NO: 3239 - protein, 189 aa, Pantoea sp.
MKLKLFLMTAGLYTGLTSVTALAATTTGAINATLTLTTGCLVNGQSATTGVNFGTLNFGSSAATFDTLNATLVGAAGSGIYVRCTTGQTFNVQVTSSNGAPGTIYGTVSGQPRYLILGSDNTRGIAYTLYSDAAFTTAIANNTNIAASGTTDPTLGTNYAIYGRVVGGGFNPLIPAGTYTDTINVAVNY

SEQ ID NO: 3240 - protein, 188 aa, Pantoea sp.
MKLKLFLLATSLSIAVPVVTQAASTTGTIAATLTLTTGCLVNGQSATTGVNFGALNFGTSAATFDTLGATLVGSSGNGIYVRCTTGQTFNVQVTGSNTAPATVYGTASTQPRYLRLSSDNTQGIAYTLYSDSAYTTAIANNTNIAASGVTDATLGTNYAIYGRIVGGGYNPVIPAGTYNDTINVSVNY

SEQ ID NO: 3241 - protein, 188 aa, Erwinia sp.
MKMKLFLLGCGLGLGVASSGFAATTTGTINATLVLTTGCLVNGQTATTGVNFGTLDFGSSAATFDTLNATLVGALGNGIFVRCTTGQTYNVQLTSSNAAPATVFGEVTAQPRYLVLGSNATQGIAYTLYNSTSYTTPIANNTNLTSTGTTDPTNGDNYPIYGRITGGGFNAAIPAGTYTDTINVAVNY

SEQ ID NO: 3242 - protein, 188 aa, Erwinia sp.
MKMKLFLLGCGLSLGVASSGFAATTTGTINARLVLTTGCLVNGQSATTGVNFGTLDFGSSAATFDTLNATLVGSLGNGIFVRCTTGQTYNVQLTSSNAAPATVFGAVTAQPRYLVLGSDATQGIAYTLYGTTSYTTPIANSTNLTNTGTTDPVNGDNYPIYGRITGGGFNAAIPAGTYTDTINVAVNY

SEQ ID NO: 3243 - protein, 190 aa, Erwinia sp.
MKIKLFLVGCGLSLGVASSGFAATTTGTMNATLTLTTGCLVNGGTATTGVNFGTLDFGSSAATFDTLNATLVAPGSAGNGINVRCTTGQTFNVRITSSNPAPGTVYGTVTSAPRYLVLGSDATQGIAYTLYSDAGFATSIANNADLVSSGTPDPVLGTNFPVYGRVTGGGQNAAIPAGTYTDTINVAVNY

SEQ ID NO: 3244 - protein, 188 aa, Pantoea sp.
MKMKLFLLGCGLGLGVASCGFAATTTGTINAQLVLTTGCLVNGQSATTGVDFGTLDFGSSAATFDTLNATLVGSLGNGIFVRCTTGQTYNVQLTSSNTAPTTVFGAVTAQPRYLVLGSDATQGIAYTLYSTTSYTTPIANNTDLTNTGTTDPVNGENYPIYGRITGGGFDATIPAGTYTDTISVAVNY

SEQ ID NO: 3245 - protein, 188 aa, unknown
  environmental sample
MKMKLFLLGCGLSFGVVSSGFAATTTGTIAARLVLTTGCLVNGQSATSAVNFGTLDFGSSAATFDTLNATLVGSLGNGIFVRCTTGQTYNVQLTSSNAAPATVYGTVTAQPRYLVSATNATQGVAYTLYGTTSYTTPIANNTNLTNTGTADPVNGDNYPIYGRIAGGGYNAAIPAGTYTDTINVAVNY

SEQ ID NO: 3246 - protein, 117 aa, Pantoea sp.
MWDVDTTKRFDEWFKAQSEELKEDMLAAIVILSEYGPHLARPFADTVDGSDFPNMKELRVQHQGKPIRAFFAFDPSRRGIVLCAGDKTGVKEKKFYKDMIKLADAEFRKYLNGGDNG

SEQ ID NO: 3247 - protein, 117 aa, unknown
  environmental sample
MWDVDTTKRFDEWFKAQTEELKEDMLAAIVILSEYGPQLARPFADTVDGSDFSNMKELRVQHQGKPIRAFFAFDPSRRGIVLCAGDKTGVKEKKFYKDMIKLADAEFRKYLNGGDNG

SEQ ID NO: 3248 - protein, 113 aa, Klebsiella sp.
MWDVETTEVFDKWFEAQIEALKEDMLAAMVILSEYGPQLGRPFADTVNDSAFSNMKELRVQHRGSPIRAFFVFDPSRRGIVLCAGDKTGLNEKRFYKDMIKLADAEYRKHLNQ

SEQ ID NO: 3249 - protein, 113 aa, Citrobacter sp.
MWDVETTDAFDKWFDVQTEALKEDMLAAMMILSEYGPQLGRPFADTVNDSVFSNMKELRVQHQGNPIRAFFAFDPSRHGIVLCAGDKTGINEKKFYKDMIKFADVEYRKHLNK

SEQ ID NO: 3250 - protein, 98 aa, unknown
  environmental sample
MWDVDTTKRFDEWFKAQSEELKEDMLAAIVILSEYGPHLARPFADTVDGSDFPNMKELRVQHQGKPIRPFFAFDPSRRGIVLCAGDKTGLRKRNSIKT

SEQ ID NO: 3251 - protein, 113 aa, unknown
  environmental sample
MWDVETTDVFDMWFEVQTAALKEDMLAAMLILSEYGPQLGRPFADTVNGSTFSNMKELRIQHQGHPIRAFFVFDPARHGIVLCAGDKTGFNEKRFYKDMIKLADAEYRKHLNQ

SEQ ID NO: 3252 - protein, 113 aa, Salmonella sp.
MWDVETTDVFDEWFAAQADVLKEDLLAAMIILSEQGPQLGRPYADTVNGSSFSNMKELRIQHQGNPIRAFFAFDPSRHGIVLCAGDKTGLNEKRFYRDMIKLADAEYRKHLNK

SEQ ID NO: 3253 - protein, 114 aa, Escherichia sp.
MMWDVETTETFDNWFDAQTVALKEDLLAAMLILAEYGPQLGRPFADTVNDSQFSNMKELRVQHQGNPVRAFFAFDPARRGIVLCAGDKTGLNEKKFYRDMIKLADSEYRKHLKK

SEQ ID NO: 3254 - protein, 113 aa, Kluyvera sp.
MWSVETTDVFDSWFEEQAEALREDVLAAMVILSEYGPQLSRPFADTVNGSAFSNMKELRIQHQGNPIRAFFAFDPSRCAIVLCAGDKTGLNERRFYKEMIKLADAEYRKHLNK

SEQ ID NO: 3255 - protein, 770 aa, Pantoea sp.
SGGYGISVSASVNAGKGRENGNGLTHTETTLTAGNGLSLNAGRDTMLTGAQVRGDSVKVDTGRNLTLTSEQDSDRYDSKQQNASAGGSFTFGSMTGSASVNLSQDKMHSNWQSVAEQTGIFAGKGGFDVTAGGHTQLNGAVISSTATADKNRLDTGTLGFSNIENHADYKTEHQSVGMSTGGSIGSQFEGNMANGLLAGLNGSGSASSVTKAAVSDGTLIIRDKAKQTQDVSALSRDAAGANPGLDKIFDKEKEQRRMETAQLLAEIGSLAGDIARTQGDIAATKAATEKMKNISPDQKKDAEAQWRKANPGQEPTAADITGQVYQTLYNREMLAGGMGTGGSVQQGISAATAAIQGLAGGNIAQAMSGAAAPYLAEQIHKLTTTKGPDGKEVVNVQANLIAHAVVGAVTSYASGNPALAGASGAAMGEYIAQQMYPGVKREDLSEEQRQTISALGTLAAGLAGGVAGDSTGGAVAGAQAGKNAVENNALHAPDEKKRQDAKWSLPYLEGEKKQQAEQLISDLDAKDKAFDVALDSACKGLSSAACQGMRQELAAMGKSYSEQLDGQYIGNMGSVYKEGKGQVDALIWQYATADAKAERDANVNRIAENWGVSKETADGLYTTMAGVHTAAAIGGALWGLKGPGTVTVYRVEGTPNTRVVIGDNGQVSITGNTTLYLNFGDKARALEFFEKRGSQNMDGAAIKTFEVPHSVLDDLRNTVVKESVARLPENKGKPVIADPTKAKDQYGIRPEKLEELKDKIIQGTGRNASK

SEQ ID NO: 3256 - protein, 653 aa, Pantoea sp.
TGIFAGKGGFDVTAGGHTRLNGAVISSTATADKNRLDTGTLGFSNIENHADYKTEHQSVGMSTGGSIGSQFEGNMANGLLAGLNGSGSASSVTKAAVSDGTLIIRDKAKQTQDVSALSRDAAGANPGLDKIFDKEKEQRRMETAQLLAEIGSQAGDIARTYGQIEATKAATEKMKTVTPDQKKDAEAQWRKANPGQEPTAADITGQVYQTLYNREMLAGGMGTGGSVQQGISAATAAIQGLAGGNIAQAMSGAAAPYLAEQIHKLTTTKGPDGKEVVNVQANLIAHAVVGAVTSYASGNPALAGASGAAMGEYIAQQMYPGVKREDLSEEQRQTISALGTLAAGLAGGVAGDSTGGAVAGAQAGKNAVENNALHAPDEKKRQDAKWSLPYLEGEKKQQAEQLISDLDAKDKAFDVALDSACKGLSSAACQGMRQELAAMGKSYSEQLDGQYIGNMGSVYKEGKGQVDALIWQYATADAKAERDANVNRIAENWGVSKETADGLYTTMAGVHTAAAIGGALWGLKGPGTVTVYRVEGTPNTRVVIGDNGQVSITGNTTLYLNFGDKARALEFFEKRGSQNMDGAAIKTFEVPHSVLDDLRNTVVKESVARLPENKGKPVIADPTKAKDQYGIRPEKLEELKDKIIQGTGRNASK

SEQ ID NO: 3257 - protein, 411 aa, unknown
  environmental sample
MLLKLKTMNKINLTSILLSAFIFLSGCNKEVLVDLDIPEAGSFARLYMPQAASNPVNMGISITDQDYAVPYAAHLGGSLRAQADIPVSFKVSPEMVAAYNQKNNTAYRMMPQGSYTLQTETATIPKGAQGTGILKLIIKTKGFLNAFESYLLPVSISAPAGVNLNNELSTTYFVFTGAYAPGEVPREKVLSMGADAGTFLIDFNSDFIRKDPASGELILYRADAVTGQFTAPPKTIGWGWNVMDKIFSYGGNRLIARFGSGGGNINQYFLSQDGVFGAQRQVGQGWGGLAAIVPFKGLLLGIAPNGDMTKFPLNGDGDFDYGNIRQIGSGWTGFTQIFSYQNSLITVDNSGNMWQYPLSDDGVFGTRRKIGTGWDMYVKVITSGTDLLALDANGDLWRYKFNPEGLWPLKK

SEQ ID NO: 3258 - protein, 199 aa, Chromobacterium sp.
MLYLRLMLRGFLLAVLLVVLGFACVAWSIVDYGSGDEVPGADAALVLGAAAWGNKPSPVFRERINHAVKLYQSGKVRWIVFTGGTPEPGYPAEADVGREFAARQGVPMTAMLVENQSRTTWQNLSNARDLGNQFGIRSYLLVSDPLHMRRAVLMAGDLGLRAYPAPTQSSRFRTLASWSRFLARETWLYVGYRVFRQLS

SEQ ID NO: 3259 - protein, 199 aa, Chromobacterium sp.
MLYLRLMMKGFLLAVLLVVLGFAYIAWTIVDYGDGDEQNGADAALVLGAAAWGNKPSPVFRERINHAVKLYQGGKVRWIVFTGGTPQPGYPSEADVGREFAARQGVPMTAMLVETESRTTWQNLSNARDLGRQFGIRSYLLVSDPLHMRRAVLMAADLGLRAYPAPTQSSRFRTLSSWSRFLARETWLYVGYRAFRQLS

SEQ ID NO: 3260 - protein, 199 aa, Chromobacterium sp.
MLYLRLMLKGFLLAILLVVLGFSYVAWSIVDFGSNASEPQADAALVLGAAAWGKRPSPVFRERINHAVKLYKSGKVRWIVFTGGTPEPGYPSEADVGRDFAAKQGVPMTAMLAENQSRTTWQNLENARELSSQFGIRSFLLVSDPLHMRRSVLMATDIGLVAYPAPTQSSRYRTLSSWSRFLARETWLYLGYRVFRKLS

SEQ ID NO: 3261 - protein, 199 aa, Chromobacterium sp.
MLYLRLMLKGFVLAILLVVLGFSYVAWSIVDFGGSANEPQADAALVLGAAAWGKRPSPVFRERINHAVKLYKSGKVRWIVFTGGTPEPGYPSEADVGRDFAAKQGVPMTAMLAENQSRTTWQNLENARELSSQFGIRSFLLVSDPLHMRRSVLMATDIGLTAYPAPTQSSRYRTLSSWSRFLARETWLYIGYRVFRKLS

SEQ ID NO: 3262 - protein, 199 aa, Paludibacterium sp.
MQYLRLMLRGFMLAVLLLLVFTALTAWRIVDYGARTSDDSADAALVLGAAAWGDRPSPVFRERIRHAVDLYQRGKVRWIVFTGGTPVPGYPSEAEVGRAFALRAGVPMTAMLAETESRTTWENISNARRLAEPFGIHSYLLVSDPWHMRRAVLMAEDLGIDVAPSPTVSTRFRTLTVRCGFLMRETWLYIGYRIFRTLS

SEQ ID NO: 3263 - protein, 245 aa, Pseudomonas sp.
MSKSIAVSQQSQQLHNDVQEAVKSIMGATQLKASDYGRVLRSALAASQKTVTIEIAAGDLTQLKKSGYKLCFAKKVGDADYNVVWQSYDAYLSNNEFSWTPQYQLFASNLFKANVQVKVSTNIVNIGLGQTSTLDEHGLLSSAVTGGPSISMTFVNDYAPIHPGINQLSTGIDGNQVSTPIYVAVDQVVTGETVLTPVETILVWFEQNVQTSTMFSTSRSKAIEIDLTFDNTAGRLYEGGQWKTV

SEQ ID NO: 3264 - protein, 247 aa, Pseudomonas sp.
MSKSIAVSQQSQQLHNDVQEAVKSIMGATPTQLKAADYGRVLRSALAASQKTVTIEIAAGDLTLLKKSGYKLCFAKKVGDADYNVVWQSYDAYLSNNEFSWTPQYQLFASNLFKANVQVKVSTNTVNIGLGQTSTLDEHGLLSSAVTGGPDISMTFVNDYGPIHPGINQLSTGIDGNQVSTPIYVAVDQVVTGNTVLTPVETILVWFEQNVQTSTMFSTSRSKAIEIDLTFDNTAGRLYEGGQWKTV

SEQ ID NO: 3265 - protein, 245 aa, Pseudomonas sp.
MSKSIAVSQQSQQLHNDVQEAVKSIMGATQLKASDYGRVLRSALAASQKTVTIEIAAGDLTQLKKSGYKLCFAKKVGDADYNVVWQSYDAYLSNNEFSWTPQYQLFASNVFRENVQVKVSTNIINIGLGQTSTLDQHGLLSPAVTGGPNISLTFVNDYAPIHPGVNQLSTGIDGNQVSTPIYVAVNQVVTGSTALTPVETILVWFEQNVQTSTMFSTSRSKAIEIDLTFDNTAGRLYEGGQWKTV

SEQ ID NO: 3266 - protein, 233 aa, Pseudomonas sp.
MSKSIAVSQQSQQLHNDVQEAVKSIMGATQLKASDYGRVLRSALAASQKTVTIEIAAGDLTLLKKSNYKLCFAKKVGDADYNVVWQSYDAYLSNNEFSWTPQYQLFASNLFKANVQVKVSTNIVNIGLGQTSTLDEHGLLSSAVTGGPNISMTFVNDYAPIHPGINQLTTGIDGNLVTGETVLTPVETILVWFEQNVQTSTMFSTSRSKAIEIDLTFDNTAGRLYEGGQWKTV

SEQ ID NO: 3267 - protein, 247 aa, Pseudomonas sp.
MSKSIAVSQQSQQLHNDVQEAVKSIMGATPTQLKAADYGRVLRSALAASQKTVTIEIAAGDLTLLKKSGYKLCFAKKVGDADYNVVWQSYDAYLSNNEFSWTPQYQLFASNVFKENVQVKVSTNIVNIGLGQTSTLDPSGLLSSAVTGGPETSLSFVNNYAPIHPGVNQLSTGIDGNQVSTPIYVAVNPVVTGNTVLTPVETILVWFEQNVQTSTMFSTSRSKAIEIDLTFDNTAGRLYEGGQWKTV

SEQ ID NO: 3268 - protein, 244 aa, Pseudomonas sp.
MSKSIAVSQQSQQLHDVQEAVKSIMGATQLKAADYNKVFRSTLAAIQKVVTIEIAPGDLSLLKKSGYKLCFAKKVGTEDYNVVWQSYNAYLSNNEFSWTPQYQLFASNVFKENVQVKVSTNIVNIGLGQTSTLDEHGLLSSAVTGGPNTSMTFVNDYAPIHPGINQLSTGIDGTQVSTPIYVAVDQVVTGNTVLTPVETILVWFEQNVQTSTMFSTSRSKAIEIDLTFDNTAGRLYEDGQWKTV

SEQ ID NO: 3269 - protein, 245 aa, Pseudomonas sp.
MSKSIAVSQQSQQLHNDVQEAVKSIMGATQLKASDYGRVLSSALAASQKVVTIEIAPGDLTQLKKSGYKLCFAKKVGTEDYNVVWQSYDAYLSNNEFSWTPQYQLFATNVFRENVQVKVSTNIVNIGLGQTSTLDQHGLLSPAVTGGPTISMTFVNDYAPIHPGVNQLSTGIDGTQVSTPIYVAVNQVVTGNTVLTPVETILVWFEQNVQTSTMFSTSRSKAIEIDLTFGNTAGRLYEGGVWKTI

SEQ ID NO: 3270 - protein, 246 aa, Pseudomonas sp.
MSKSIAVSQQSQQLQNDVQEAVKSIMGATTALKSTDYGRVFRSVLAASQKTVTIEIAPGDLTLLKKSGYKLCFAKKVGTADYNVVWQSYSAYLSNNEFSWTPLYQLFASNVFKENVQVKVSTNIVNIGLGQTSTLDEHGLLSPAVTGGPEVSVTFVNNFAPIHPGINQLSTGIDGNQVSTPIYVAVNQVVTGNTVLTPVETILVWFEQDVQTSTMFSSSRSKAIEIDLTFDNTAGRLYEGGQWKTV

SEQ ID NO: 3271 - protein, 246 aa, Pseudomonas sp.
MSKSIAVSQQSQQLHNDVQEAVKSIMGAATALKSTDYGRVLRSALAASQKTVTIEIAPDDLTQLKKSGYKLCFAKKVGTADYNVVWQSYSAYLSNNEFSWTPLYQLFATNVFQENVQVKVSTNVVNIGLGQTSTLDEHGLLSPAVTGGPEVSVTFVNNFAPIHPGINQLSTGIDGNQVSTPIYVAVNRVVTGNTVLTPVETILVWFEQDVQTSTMFSTSRSKAIEIDLTFDNTAGRLYEGGQWKTV

SEQ ID NO: 3272 - protein, 245 aa, Pseudomonas sp.
MSKSIAVSQQSQQLHNDVQEAVKSIMGATQLKTADYNKVLRSTLAAVQKVVTIEIAPGDLSTLKNSGYKLCFAKKVGTEDYNVVWQSYDAYLSNNEFSWTPQYQLFASNVFKENVQVKVSTNIVNIGLGQTSTLDKNGLLSPAITGGPDVSFTFVNNYAPIHPGVNQLSTGIDGNQVSTPIYVAVNQVVTGNTVLTPVETILVWFEQNVQTSTMFSTSRSKAIEIDLTFDNTAGRLYEGGQWKTV

SEQ ID NO: 3273 - protein, 246 aa, Pseudomonas sp.
MSKSTAVSAHQKQLHDDVQAAVKSIMAAPTALKTSDYSKVLTSTLAATQKSVKIQIASGDLTTLKQSGYKLCFAKKVGTEAYNVVWQSYVAYLSNSTFSWTPQYQLFGSNSFQANVQVDVSTNIVNIGLGQQSVLDTSGLLGSATTGGPDTSITLINNYGAIHPGISQLSTGIDGKQVSTPIYVASNQIVTGSTVLTPVETILVWFEQNVQTSTMFSTSRSQSVEIDLTFDNSATRLYSGGSWTVV

SEQ ID NO: 3274 - protein, 247 aa, Pseudomonas sp.
MSQSSAVSKQSQQLHKDVQEAFKSFQSVAPTALKTTDYSKVLTSTLAATQKSVKIQIAAADLTLLKQSGYKLCFAKKVGNEAYNVVWQSYVQYLSNSTFSWTPQYQLFGANSFQANVQVDVSTNLVNIGLGQQSILDNAGLLGSATSGGPDTSITLVNNYGAIHPGLSQLSTGIDGRQISTPIYVASAQVVTGQTVLTPVETILVWFEQNVQTSTMFSTSRSQSIEIDLTFDNSATRLYSGGSWTVV

SEQ ID NO: 3275 - protein, 247 aa, Pseudomonas sp.
MSQSSAASKQSQQLHKDVQEAFKSFQSVAPTALKTTDYSKVLTSTLAATQKSVKIQIASADLTLLKQSGYKLCFAKKVGNEAYNVVWQSYVQYLSNSTFSWTPQYQLFGANSFQANVQVDVSTNLVNIGLGQQSILDNAGLLGSATSGGPDTSITLVNNYGAIHPGLSQLSTGIDGRQISTPIYVASAQVVTGQTVLTPVETILVWFEQNVQTSTMFSTSRSQSVEIDLTFDNSATRLYSGGLWTIP

SEQ ID NO: 3276 - protein, 167 aa, Pseudomonas sp.
MRWLLALFCLSFVTVSQASAVETLDGKVIEKILILKSSHQLQLINDGKPLKTYRISLGKRPKGPKLMEGDKRTPEGFYWVDWRKISDRFNLAMHISYPNISDSARARREGVEPGGMIMIHGTPDSEDTPEDLFHTLDWTDGCIAMRNMDMREVWNLVPDGTMIEIRP

SEQ ID NO: 3277 - protein, 167 aa, Pseudomonas sp.
MRWLLALFCLSFVTVSQASAVETLDGKVIEKILILKSSHQLQLINDGKPLKTYRISLGKRPKGPKLMEGDKRTPEGFYWVDWRKVSDRFNLAMHISYPNISDSARARREGVEPGGMIMIHGTPDSEDTPEDLFHTLDWTDGCIAMRNMDMREVWNLVPDGTMIEIRP

SEQ ID NO: 3278 - protein, 167 aa, Pseudomonas sp.
MRWLLALFCLSFVTVSQASAVETLDGKVIEKILILKSSHQLQLINDGKPLKTYRISLGKRPTGPKLMEGDKRTPEGFYWVDWRKVSDRFNLAMHISYPNISDSARARREGVEPGGMIMIHGTPDTEDTPEDLFHTLDWTDGCIAMRNMDMREVWNLVPDGTMIEIRP

SEQ ID NO: 3279 - protein, 167 aa, Pseudomonas sp.
MRWLLALFCLSFVTVSQASAVETLDGKVIEKILILKSSHQLQLINDGKPLKTYRISLGKRPKGPKLMEGDKRTPEGFYWVDWRKTSDKFNLAMHISYPNISDSARARREGVEPGGMIMIHGTPDTVDTPEDLFHTLDWTDGCIAMRNMDMREVWNLVPDGTMIEIRP

SEQ ID NO: 3280 - protein, 167 aa, Pseudomonas sp.
MRWLLALFCLSFVAVSQASAVETLDGKLIEKILILKSSHQLQLINDGKPLKTYRISLGKRPKGPKLMEGDKRTPEGFYWVDWRKVSDRFNLAMHISYPNISDSARARREGVEPGSMIMIHGTPDTEDTPEDLFHTLDWTDGCIAMRNMDMREVWNLVPDGTMIEIRP

SEQ ID NO: 3281 - protein, 167 aa, Pseudomonas sp.
MRWLLALFCLSFVAVSQASALEPLDGKVIEKILVLKSSHQLQLINDGKPLKTYRISLGKRPKGPKLMEGDKRTPEGLYWVDWRKVSDKFNLAMHISYPNISDSARARREGVEPGGMIMIHGTPDTEDTPEDLFHTLDWTDGCIAMRNMDMREVWNLVPDGTMIEIRP

SEQ ID NO: 3282 - protein, 167 aa, Pseudomonas sp.
MRWLLAVFCLSFVTVTQASSTETLDGKVIEKVLVLKSAHQLQLINDGKPIKTYRISLGKRPKGPKLMEGDKRTPEGFYWVDWRKISDRFNLAMHISYPNISDAARARREGVEPGGMIMIHGTPDTEDNPEDLFHTLDWTDGCIAMRNMDMREVWGLVPDGTMIEIRP

SEQ ID NO: 3283 - protein, 167 aa, Pseudomonas sp.
MRWLLAVFCLSFVAVTQASSTETLDGKVIDKVLVLKSAHQLQLINDGKPIKTYRISLGKRPKGPKLMEGDKRTPEGFYWVDWRKISERFNLAMHISYPNISDSARARREGVEPGGMIMIHGTPDTEDNPEDLFHTLDWTDGCIAMRNMDMREVWGLVPDGTMIEIRP

SEQ ID NO: 3284 - protein, 167 aa, Pseudomonas sp.
MRWLLAVFCLSFVAVTQASSTETLDGRVIEKVLVLKSAHQLQLINDGKPIKTYRISLGKRPKGPKLMEGDKRTPEGFYWVDWRKISDRFNLSMHISYPNISDAARARREGVEPGGMIMIHGTPDTEDNPEDLFHTLDWTDGCIAMRNMDMREVWGLVPDGTMIEIRP

SEQ ID NO: 3285 - protein, 167 aa, Pseudomonas sp.
MRWLLALFCLSFVAVSQASVAETLDGKVIEKVLVLKSAHQLQLINDGKPIKTYRISLGKRPIGAKLMEGDKRTPEGFYWLDWRKVSDRFNLAMHISYPNISDSVRSRREGVEPGGMIMIHGTPDTEENPEDLFHTLDWTDGCIAMRNMDMREVWGLVPDGTMIEIRP

SEQ ID NO: 3286 - protein, 167 aa, Pseudomonas sp.
MRWLLAVFCMSFVAISQASTAETLDGKVVEKVLVLKSAHQLQLINDGKPLRTYRISLGKRPVGPKLMEGDKRTPEGFYWVDWRKTSDRFNLSMHISYPNISDAARARREGVEPGGMIMIHGTPDTEDNPEALFHTLDWTDGCIAMRNMDMREVWGLVPDGTMIEIRP

SEQ ID NO: 3287 - protein, 167 aa, Erwinia sp.
MRWLLALFCCSVIAVSHASATDTLDGKVIEKVLVLKSAHQLQLINDGKPFKTYRISLGKQPKGPKLMEGDKRTPEGFYWLDWRKTSDRFNLAMHISYPNISDSARSRREGVEPGGMIMIHGTPDSEDYPEQYFHTLDWTDGCIAMRNVDMREVWGLVPDGTMIEIRP

SEQ ID NO: 3288 - protein, 167 aa, Pseudomonas sp.
MRWLLAFLCLSFVAVTQASTVETLDGKVIEKVLVLKSAHQLQLINDGKPIKTYRISLGKNPKGQKLMEGDRRTPEGFYWLDWRKVSDRFNLAMHISYPNISDAARSRREGVNPGGMIMIHGTPDTEENPEDLFHTLDWTDGCIAMRNVDMREVWGLVPDGTMIEIRP

SEQ ID NO: 3289 - protein, 167 aa, Pseudomonas sp.
MRWLFALLCLSLTVASHASTVETLDGKIIEKVLVLKSAHQLQLINDGKPLKTYRISLGKQPKGPKLMEGDKRTPEGFYWLDWRKTSDRFNLAMHISYPNISDSARSRREGVPPGSMIMIHGTPDSEDYPEQFFHTLDWTDGCIAMRNVDMREVWGLVKDGTMIEIRP

SEQ ID NO: 3290 - protein, 171 aa, Pseudomonas sp.
MRWLLALFCLSFVTVSQASFVTTVTPANTPFIEKVLVLKSAHQLQLIADGKPLKTYRISLGKGAKKGPKLIEGDKRTPEGFYWIDWRKTSDKFNLSMHISYPNISDSARARREGVEPGGMIMIHGTPDSEETPEDLFHTLDWTDGCVAMRNVDMREVWNLVPDGTMVEIRP

SEQ ID NO: 3291 - protein, 171 aa, Pseudomonas sp.
MRWLLALFCLSFVSVSQASFVTTVTPANTPLIEKVLVLKSAHQLQLIADGKPLKTYRISLGKGAKKGPKLIEGDKRTPEGFYWIDWRKTSDKFNLSMHISYPNISDSARARREGVEPGGMIMIHGTPDSEETPEDLFHTLDWTDGCVAMRNVDMREVWSLVPDGTMVEIRP

SEQ ID NO: 3292 - protein, 167 aa, Pseudomonas sp.
MRWLLALICLSFATLSPASTVQTLDGKTVEKVLVLKSAHQLQLINDGKPLKTYRISLGKNPKGHKLIEGDRRTPEGLYWIDWRKTSDRFNLAMHISYPNISDAARARREGVKPGSMIMIHGTPDTEDYPEQWFHTLDWTDGCIGMRNVDMREVWNLVKDGTLIEIRP

SEQ ID NO: 3293 - protein, 167 aa, Pseudomonas sp.
MRWLLALLCLSFTTLSPASTVETLGGKTVEKVLVLKSAHQLQLINDGKPIKTYRISLGKNPKGHKLIEGDRRTPEGLYWIDWRKTSDRFNLAMHISYPNISDAARARREGVKPGSMIMIHGTPDTEDYPEQWFHTLDWTDGCIAMRNVDMREVWTLVKDGTLIEIRP

SEQ ID NO: 3294 - protein, 171 aa, Pseudomonas sp.
MRWLLALFCLSFAMVSQASFVTTVKPSNTPMIEKVLVLKSAHRLQLIADGKPLKTYRISLGKGAKKGPKLIEGDKRTPEGFYWIDWRKTSEKFNLSMHISYPNITDSARARREGVEPGGMIMIHGTPDTEENPEDLLHTLDWTDGCIAMRNVDMREVWSLVPDGTMIEIRP

SEQ ID NO: 3295 - protein, 167 aa, Pseudomonas sp.
MRWLLALFCLSFATLSSASTLHTLHGKTVEKVLVLKSAHQLQLINDGKPFKTYRISLGKNPKGQKLIEGDRRTPEGLYWIDWRKTSEHYNLAMHISYPNISDSARARREGVNPGSMIMIHGTPDSDEYPEQWFHTLDWTDGCIGMRNVDMREVWNLVKDGTLIEIRP

SEQ ID NO: 3296 - protein, 167 aa, Pseudomonas sp.
MRWLFAVFCLSFATLSQATAADPLQGRVIEKVLVLKSAHQLQLINDGKPLKTYRISLGRNPRGPKLIEGDRRTPEGFYWIDWRKTSDKFNLSMHISYPNISDAARARREGVNPGSMIMIHGTPDSEDYPEQWLHTLDWTDGCIGMRNVDMREVWSLVKDGTLVEIRP

SEQ ID NO: 3297 - protein, 167 aa, Pseudomonas sp.
MRWLLAVFCLSFAALSQASAADPLQGRMIEKVLVLKSAHQLQLISDGKPLKTYRISLGRNPKGQKLIEGDRRTPEGFYWIDWRKTSDKFNLSMHISYPNISDAARARREGVNPGSMIMIHGTPDSEDYPEQWLHTLDWTDGCVGMRNVDMREVWNLVKDGTLVEIRP

SEQ ID NO: 3298 - protein, 167 aa, unknown
  environmental sample
MRWLLALLCLSFATLAPASTLQPPGALPVEKVLVLKSAHQLQLINDGKPFKTYRISLGKNPKGHKLIEGDRRTPEGLYWIDWRKTSDRFNLSMHISYPNISDAARARREGVKPGSMIMIHGTPDTEDYPEQWFHTLDWTDGCIGMRNVDMREVWNLVKDGTLIEIRP

SEQ ID NO: 3299 - protein, 166 aa, Pseudomonas sp.
MRWLLAVFCLSFAALTQASADPLQGRMIEKVLVLKSAHQLQLVSDGKPLKTYRISLGRNPKGQKQVEGDRRTPEGFYWIDWRKTSDKFNLSMHISYPNISDAARARREGLNPGSMIMIHGTPDSEDYPEQWLHTLDWTDGCVGMRNVDMREVWSLVKDGTLVEIRP

SEQ ID NO: 3300 - protein, 185 aa, Pseudomonas sp.
MRWLFALFCLSVASVSQAAFTETIVTKPIEKVAPSPLQLKPATTAQIDKILVLKSERRLQLISGGAPLKTYRISLGKQPKGPKLREGDKRTPEGFYWIDWRKESDRYNLAMHVSYPNISDSARARREGVPPGGMIMIHGTPLDEEYPEEVFHTLDWTEGCIAMTNRDMREVWNMVPDGTMIEIRP

SEQ ID NO: 3301 - protein, 173 aa, Pseudomonas sp.
MEAHHVKSLLAVLSLIALPVMAAEPTLYGRYEYIALPEIGGQVLKAKMDTGALTASLSAKDIETFKRDGEDWVRFRLGTKDANNKVYEHKIARISKIKTRSEEEEEDSEMIAPTKRPVVDLELCLGNVKRTVEVNLTDRSSFNYPLLIGAKALREFGAAVNPARRFTADKPDC

SEQ ID NO: 3302 - protein, 172 aa, Pseudomonas sp.
MEAHHVKSLLAVLSLIALPVLAAEPTLYGRYEYIALPEIGGQVLKAKMDTGALTASLSAKDIETFKRDGEDWVRFRLATKDASNKVYEHKIARISKIKTRSEEEEDDEAAAPTKRPVVDLELCLGNVKRTVEVNLTDRSSFNYPLLIGAKALREFGAAVNPARRFTADKPDC

SEQ ID NO: 3303 - protein, 168 aa, Pseudomonas sp.
MKSLLALLSLIALPVMAAEPTLYGRYEYIALPEIGGEVLKAKMDTGALTASLSAKDIETFTRDGEDWVRFRLATKGASNKVYEHKVARISKIKTRSEEDEDDSEVIAPTKRPVVDLELCLGNVKRTVEVNLTDRSSFNYPLLIGAKALREFGAAVNPARRFTADKPDC

SEQ ID NO: 3304 - protein, 177 aa, Pseudomonas sp.
MLTLLETHYVKSLLAVLSLIALPVMAAEPTLYGRYEYIALPEIGGQVLKAKMDTGALTASLSAKDIETFKRDGEDWVRFRLGTKDAGNQVYEHKVARISKIKTRTEEDEEDSEVVAPTKRPVVDLELCLGNVKRTVEVNLTDRSSFNYPLLIGAKALREFGAAVNPARRFTADKPDC

SEQ ID NO: 3305 - protein, 168 aa, unknown
  environmental sample
MKSVLALLSLMALPVLAAEPTLYGRYEYIALPEIGGEVLKAKMDTGALTASLSAKDIETFTRDGDDWVRFRLATKDASNKVYEHKIARISKIKTRSEEDEEDDEKIAPTKRPVVDLELCLGNVKRTVEVNLTDRSSFNYPLLIGAKALREFGAAVNPARRFTADKPDC

SEQ ID NO: 3306 - protein, 168 aa, unknown
  environmental sample
MKSVLALLSLVALPVLAAEPTLYGRYEYIALPEIGGKVLKAKMDTGALTASLSAKDIETFTRDGDDWVRFRLATKDADNKVYEHKIARISKIKTRSEEDEEDDEKIAPTKRPVVDLELCLGNVKRTVEVNLTDRSSFNYPLLIGAKALREFGAAVNPARRFTADKPEC

SEQ ID NO: 3307 - protein, 168 aa, unknown
  environmental sample
MKSVLALLSLVALPVLAAEPTLYGRYEYIALPEIGGEVLKAKMDTGALTASLSAKDIETFTRDGDDWVRFRLATKDASNKVYEHKIARISKIKTRSEEDEDDDEKIAPTKRPVVDLALCLGNVKRTVEVNLTDRSSFNYPLLIGAKALREFGAAVNPARRFTADKPEC

SEQ ID NO: 3308 - protein, 168 aa, Pseudomonas sp.
MKSLLALLTLVALPVMAAEPTLYGRYEYIALPEIGGEVLKAKMDTGALTASLSAKDIEMFTRDGDDWVRFRLGTKDASNKVYEHKISRISKIKTRSEEDEDDKDEAAPTKRPVVDLELCLGNVKRTVEVNLTDRSSFNYPLLIGAKALREFGAAVNPARRFTADKPDC

SEQ ID NO: 3309 - protein, 167 aa, Pseudomonas sp.
MKSLLALFALVALPVMAAEPTLYGRYEYIALPEIGGEVLKAKMDTGALTASLSAKDIETFTRDGENWVRFRLGTKDASNKVYEHKIARISKIKSRSDEEDEGDSTEVAKRPVVDLELCLGNVKRTVEVNLTDRSNFNYPLLIGAKALREFGAAVNPARRFTADKPDC

SEQ ID NO: 3310 - protein, 168 aa, Pseudomonas sp.
MKSLLALLALVALPVLASEPTLYGRYEYIALPEIGGEVLKAKMDTGALTASLSAKDIETFTRDGDEWVRFRLATKGASNKVYEHKVARISKIKNRADEEDEDKAVSEVTKRPVVDLELCLGNVKRTVEVNLTDRSSFNYPLLIGAKALREFGAAVNPARRFTADKPDC

SEQ ID NO: 3311 - protein, 168 aa, Pseudomonas sp.
MKSLLALFALVALPVMAAEPTLYGRYEYIALPEIGGEVLKAKMDTGALTASLSAKDIETFTRDGEDWVRFRLATKDADNKVYEHKVARISKIKSRSDEDDEERDVTEVAKRPVVDLELCLGNVKRTVEVNLTDRSHFNYPLLIGAKALREFGAAVNPARRFTADKPDC

SEQ ID NO: 3312 - protein, 166 aa, Erwinia sp.
MKSVLALLSLLALPVMAAEPTLYGRYEYIQLPEIGETLKAKMDTGALTASLSAKDIETFTRDGEEWVRFRLATKDADGKVYEHKVARISKIKSRADEDEDKEEAQVAKRPVVDLEMCLGNVKRTVEVNLTDRSSFNYPLLIGAKALREFGAAVNPARRFTADKPDC

SEQ ID NO: 3313 - protein, 166 aa, Pseudomonas sp.
MKSVLALLSLLALPVLAAEPTLYGRYEYIQLPEIGETLKAKMDTGALTASLSAKDIETFTRDGEEWVRFRLATKDADGKVYEHKVARISKIKSRADEDEDKEEAQVAKRPVVDLEMCLGNVKRTVEVNLTDRSSFNYPLLIGAKALREFGAAVNPARRYTADKPDC

SEQ ID NO: 3314 - protein, 167 aa, Pseudomonas sp.
MKSILALLALVALPVMAAEPTLYGRYEYIKLPEIGGQVLKAKMDTGALTASLSAKDIETFTRDGEDWVRFRLGTKDASSKVFEHKVLRISKIKSRADEEDEKDTADVAKRPVVELELCLGSIKRTVEVNLTDRSSFNYPLLIGAKALREFGAAVNPARRFVADKPDC

SEQ ID NO: 3315 - protein, 166 aa, Pseudomonas sp.
MKSLLALLALAALPVMAAEPTLYGRYEYIQLPEIGETFKAKMDTGALTASLSARDIETFTRDGEDWVRFRLSGKDVSNKVYEHKVARISKIKNRADEDEDGEETSVAKRPVVDLEMCLGNVKRTVEVNLTDRSSFNYPLLIGAKALREFGAAVNPARRYTADKPDC

SEQ ID NO: 3316 - protein, 167 aa, unknown
  environmental sample
MKSILALLSLLALPVMAAEPTLYGRYEYIKVSEFGETFKAKMDTGALTASLSAKDIELFKRDGDDWVRFRLATKDASNKVYEHKVSRISKIKSRSENDDDEDEAIDPTKRPVVDLELCLGNVKRTVEVNLVDRSHFNYPLLIGAKALREFDAAVNPARRYTADKPDC

SEQ ID NO: 3317 - protein, 167 aa, unknown
  environmental sample
MKSVLALLSVLALPVMAAEPTLYGRFEYIKLPEIGGQVFKAKMDTGALTASLSAKDIQTFTRDGDDWVRFRLATKDADNKVYEHKISRISKIKNRAEEDDDGEGAEVSQRPVVDLELCLGDVKRTIEVNLVDRSKFNYPLLIGAKGLREFKAAVNPARRFVADKPDC

SEQ ID NO: 3318 - protein, 203 aa, Pseudomonas sp.
MGASLLAKDLKNERIPYWRSKIPRSTPQLPKEAHYVKSLLALLSLVALPVLAAEPTLYGRYEYIALPEIGGEVLKAKMDTGALTASLSAKDIETFTRDGDEWVRFRLATKGASNKVYEHKVARISKIKTRSEEDEDDKEAVEPTKRPVVDLELCLGNVKRTVEVNLTDRSSFNYPLLIGAKALREFGAAVNPARRFTADKPDC

SEQ ID NO: 3319 - protein, 166 aa, Pseudomonas sp.
MKSMLALLSLLALPVMAAEPTIYGRYENIALPELGETLKAKMDTGAYTASLSAKDIELFNRDGEEWVRFRLATKESDGKVYEHKVSRISKIKGRAEEEDEGDAPELSKRPVVDLELCLGDVKRTVEVNLVDRSHFNYPLLVGAKALREFKAAVNPAKRFTADKPDC

SEQ ID NO: 3320 - protein, 166 aa, unknown
  environmental sample
MKLLFASLALVALPVMAAEPTLYGRYEYIQLPEIGETFKAKMDTGALTASLSARDIETFTRDGDDWVRFRLGGKDATDKVYEHKVSRISKIKSRSDEDDDKDEASVAKRPVIDLEMCLGKVKRTVEVNLTDRSSFNYPLLIGAKALREFDAAVNPARRYTADKPDC

SEQ ID NO: 3321 - protein, 166 aa, unknown
  environmental sample
MKPILALLSLLALPVMAAEPTLYGRYENISVPEIGKTFKAKMDTGALTASLSAKDVELFKRDGDDWVRFRLATDGAGNKVYEHKVSRISKIKSRADGDDEDEDLDPVKRPVIDLELCLGDKKRTVEVNLVDRSHFNYPLLIGAKALREFDAAVNPARRYTADKPDC

SEQ ID NO: 3322 - protein, 166 aa, unknown
  environmental sample
MKSLFAMLTLLTLPVMAAEPTLYGRYENIALPEIGQTLKAKMDTGAYTASLSAKDIELFTRDGQEWVRFRLATKDDDGKVYEHQVSRISKIKGRADDEDEGDTPESAKRPVVDLELCLGDVKRTVEVNLVDRSNFNYPLLVGAKALREFKGAVNPAKRFTAGKPDC

SEQ ID NO: 3323 - protein, 167 aa, Pseudomonas sp.
MKPLIALLGLLSLPVMAAEPDLYGRYEYIGVADIGQTFKAKMDTGALTASLSARNIEQFTRDGEDWVRFRLATKDANDKVYEHKLARMSKIKNRADEEDEEGADIAHRPVIDLELCLGDVKRTVEVNLTDRSSFNYPLLIGAKALREFNAAVNPARRYTAGKPDCGK

SEQ ID NO: 3324 - protein, 167 aa, unknown
  environmental sample
MKTVLALLSLLALPAMAADPTLYGRYENIKVPEVGETFKAKMDTGAVTASLSAKDIELFKRDGEQWVRFRLASEGASNKVFEHKLARISKIKGRADEDDEDEGGVEAARRPVIELQLCLGKEQRTVEVNLVDRSHFNYPLLIGAKALREFNAAVNPARRYTADKPDC

SEQ ID NO: 3325 - protein, 166 aa, unknown
  environmental sample
MKSMLALLCTLSLPVMAADPMLYGRYEHVGLPELGETLKAKMDTGAWTASLSAKDIERFSRNGDDWVRFRLATPDADGKVYEHKLARISKIKSRADEDDEGEAAGFAKRPVIDLDLCLGNVKRTVEVNLTDRSSFDYPLLIGAKALREFKAAIDPAQRYTADKPDC

SEQ ID NO: 3326 - protein, 474 aa, Pseudomonas sp.
MSIPRLKSYLSIIATVLVLGQAVTAQAVELPDFTQLVEQASPAVVNISTTQKLPDRKVSQQMPDLEGLPPMLREFFERGMPPQSRSPRDRQREATSLGSGFIISSDGYILTNNHVIADADEILVRLADRSEMKAKLVGTDPRSDVALLKIEGKDLPVLKLGKSQDLKAGQWVVAIGSPFGFDHTVTQGIVSAVGRSLPNENYVPFIQTDVPINPGNSGGPLFNLNGEVVGINSQIYTRSGGFMGVSFAIPIDVAMDVSNQLKSGGKVSRGWLGVVIQEVSKDLAESFGLEKPAGALVAQIQDDGPAAKGGLQVGDVILSMNGQPIVMSADLPHLVGALKAGAKANLEVIRDGKRKNVELTVGAIPEEGKELGAEPKSSIERSSNRLGVSVVELTDEQKKTFDLKGGVVIKEVQDGPAAMIGLQPGDVITHLNNQAIGSTKEFADIAKALPKNRSVSMRVLRQGRASFITFKLAE

SEQ ID NO: 3327 - protein, 474 aa, Pseudomonas sp.
MSIPRLKSYLSIIATVLVLGQAVTAQAVELPDFTQLVEQASPAVVNISTTQKLPDRKVSEQMPDLEGLPPMLREFFERGMPPQSRSPRDRQREATSLGSGFIISSDGYILTNNHVIADADEILVRLADRSEMKAKLVGTDPRSDVALLKIEGKDLPVLKLGKSQDLKAGQWVVAIGSPFGFDHTVTQGIVSAVGRSLPNENYVPFIQTDVPINPGNSGGPLFNLNGEVVGINSQIYTRSGGFMGVSFAIPIDVAMDVSNQLKSGGKVSRGWLGVVIQEVSKDLAESFGLEKPAGALVAQIQDDGPAAKGGLQVGDVILSMNGQPIVMSADLPHLVGALKAGAKANLEVIRDGKRKNVELTVGAIPEEGKELGAEPKSSIERSSNRLGVSVVELTDDQKKTYDLKGGVVIKEVQDGPAAMIGLQPGDVITHLNNQAIGSTKEFADIAKALPKNRSVSMRVLRQGRASFITFKLAE

SEQ ID NO: 3328 - protein, 474 aa, Pseudomonas sp.
MSIPRLKSYLSIIATVLVLGQAVTAQAVELPDFTQLVEQASPAVVNISTTQKLPDRKVSQQMPDLEGLPPMLREFFERGMPPQSRSPRDRQREATSLGSGFIISSDGYILTNNHVIADADEILVRLADRSEMKAKLVGTDPRSDVALLKIEGKDLPVLKLGKSQDLKAGQWVVAIGSPFGFDHTVTQGIVSAVGRSLPNENYVPFIQTDVPINPGNSGGPLFNLDGEVVGINSQIYTRSGGFMGVSFAIPIDVAMDVSNQLKSGGKVSRGWLGVVIQEVSKDLAESFGLEKPAGALVAQIQDDGPAAKGGLQVGDVILSMNGQPIVMSADLPHLVGALKAGAKADLEVIRDGKRKNVELTVGAIPDEDKEMGAEPKSSIERSSNRLGVSVVELTDDQKKTYDLKGGVVIKEVQDGPAAMIGLQPGDVITHLNNQAIGSAKEFADIAKALPKNRSVSMRVLRQGRASFITFKLAE

SEQ ID NO: 3329 - protein, 474 aa, Pseudomonas sp.
MSIPRLKSYLSIIATVLVLGQAVTAQAVELPDFTQLVEQASPAVVNISTTQKLPDRKVSQQMPDLEGLPPMLREFFERGMPPQSRSPRDRQREATSLGSGFIISSDGYILTNNHVIADADEILVRLADRSEMKAKLVGTDPRSDVALLKIEGKDLPVLKLGKSQDLKAGQWVVAIGSPFGFDHTVTQGIVSAVGRSLPNENYVPFIQTDVPINPGNSGGPLFNLNGEVVGINSQIYTRSGGFMGVSFAIPIDVAMDVSNQLKSGGKVSRGWLGVVIQEVSKDLAESFGLEKPAGALVAQIQDDGPAAKGGLQVGDVILSMNGQPIVMSADLPHLVGALKAGAKADLEVIRDGKRKNVELIVGAIPDDDKDMGAEPKSSIERSSNRLGVSVVELTDDQKKTYDLKGGVVIKEVQDGPAAMIGLQPGDVITHLNNQAIGSAKEFADIAKALPKNRSVSMRVLRQGRASFITFKLAE

SEQ ID NO: 3330 - protein, 475 aa, Pseudomonas sp.
MSIPRLKSYLSIFATVLVLGQAVAAQAVELPDFTQLVEQASPAVVNISTTQKLPDRKVSEQMPDLEGLPPMLREFFERGMPPQSRSPRGDRQREAQSLGSGFIISSDGYILTNNHVIADADEILVRLADRSELKAKLVGTDPRSDVALLKIEGKDLPVLKLGKSQDLKAGQWVVAIGSPFGFDHTVTQGIVSAVGRSLPNENYVPFIQTDVPINPGNSGGPLFNLAGEVVGINSQIYTRSGGFMGVSFAIPIDVAMDVSNQLKSGGKVSRGWLGVVIQEVNKDLAESFGLEKPAGALVAQIQDDGPAAKGGLQVGDVILSMNDQPIVMSADLPHLVGALKAGSKANLEVIREGKRKNVELTVGAIPEEGKELDALPKSSIERSSNRLGVSVAELTDEQKKTYDLKGGVVIKEVQDGPASMIGLQPGDVITHLNNQAIGSTKEFTDIAKALPKNRSVSMRVLRQNRASFITFKLAE

SEQ ID NO: 3331 - protein, 476 aa, Pseudomonas sp.
MSIPRLKSYLSIFATVLVLGQAVAAQAVELPDFTQLVEQASPAVVNISTTQKLPDRRVSSEQMPDLEGLPPMLREFFERGMPQQPRSPRGDRQREAQSLGSGFIISPDGYILTNNHVIADADEILVRLADRSELKAKLIGTDPRSDVALLKIEGKDLPVLKLGKSQDLKAGQWVVAIGSPFGFDHTVTQGIVSAIGRSLPNENYVPFIQTDVPINPGNSGGPLFNLAGEVVGINSQIYTRSGGFMGVSFAIPIDVAMDVSNQLKSGGKVSRGWLGVVIQEVNKDLAESFGLEKPAGALVAQIQDDGPAAKGGLQVGDVILSMDGQPIVMSADLPHLVGALKAGSKADLEVIREGKRKNVELTVGAIPEEGKELEALPKSSVERSSNRLGVSVAELTEEQKKTLDLKGGVVIKEVQDGPAALIGLQPGDVITHLNNQAIGSSKEFTDIAKALPKNRSVSMRVLRQGRASFITFKLAE

SEQ ID NO: 3332 - protein, 476 aa, Pseudomonas sp.
MSILSLKSYLSIFATVLVLGQAVPAAQAADLPDFTQLVEQASPAVVNISTTQKLPDRKVNQQMPDLEGLPPMLREFFERGMPPQQRSPRDGRQREAQSLGSGFIISPDGYILTNNHVIADADEILVRLADRSEMKAKLIGTDPRSDVALLKIEGKDLPVLKLGKSQDLKAGQWVVAIGSPFGFDHTVTQGIVSAVGRSLPNENYVPFIQTDVPINPGNSGGPLFNLNGEVVGINSQIYTRSGGFMGVSFAIPIDVAMDVSNQLKSGGKVSRGWLGVVIQEVNKDLAESFGLDKPAGALVAQIQDDGPAAKGGLQVGDVILSMNGQPIVMSADLPHLVGALKAGAKANLEVIREGKRKNVELTVGAIPDEDKELDTLAKSGAESSSNRLGVAVGELTAEQKKAYDLKGGVVIKEVQDGPAALIGLQPGDVITHLNNQAIGSAKEFTDIAKALPKNRSVSMRVLRQGRASFITFKLAE

SEQ ID NO: 3333 - protein, 476 aa, Pseudomonas sp.
MSIPRLKSYFTILATVLVLGQAVSAQAAELPDFTQLVEQASPAVVNISTTQKLPDRRVSNSAQMPDLEGLPPMLREFFERGMPQPRSPRGDRQREAQSLGSGFIISADGYILTNNHVIADADEILVRLADRSELKAKLIGTDPRSDVALLKIDGKDLPVLKLGKSQDLKAGQWVVAIGSPFGFDHTVTQGIVSAIGRSLPNENYVPFIQTDVPINPGNSGGPLFNLAGEVVGINSQIYTRSGGFMGVSFAIPIDVAMDVSNQLKTGGKVSRGWLGVVIQEVNKDLAESFGLEKPAGALVAQIQDDGPAAKGGLQVGDVILSLNGQPIVMSADLPHLVGALKAGAKANLEVIRDGKRKNVELTVGAIPEEDKDLSMLPKSGVERSSNRLGVAVVELNDEQKKAFDLKGGVVIKEVQDGPAALIGLQPGDVITHLNNQAITSAKEFTEIAKALPKNRSVSMRVLRQGRASFITFKLAE

SEQ ID NO: 3334 - protein, 478 aa, unknown
  environmental sample
MSIPRLKSYLSIIATVLVLGQALPAQAVELPDFTQLVEQASPAVVNISTTQKLPDRKVSNQPMPDLEGLPPMLREFFERGMPQPRTPRGGGGQREAQSLGSGFIISPDGYILTNNHVIADADEILVRLADRSELKAKLVGTDPRSDVALLKIEGKDLPVLKLGKSQDLKAGQWVVAIGSPFGFDHTVTQGIVSAIGRSLPNENYVPFIQTDVPINPGNSGGPLFNLAGEVVGINSQIYTRSGGFMGVSFAIPIDVAMDVSNQLKSGGKVSRGWLGVVIQEVNKDLAESFGLDKPAGALVAQIQDDGPAAKGGLQVGDVILSMNGQPIVMSADLPHLVGALKAGSKAKLEVIRDGKRQNVELTVGAIPEEGATLDALGNAKPGAERSSNRLGIAVAELTPEQKKTFDLKSGVVIKEVQDGPASLIGLQPGDVITHLNNQAIDSTKQFTDIAKALPKNRSVSMRVLRQGRASFITFKLAE

SEQ ID NO: 3335 - protein, 479 aa, Pseudomonas sp.
MSIPRLKSYLSIVATVLVLGQALPAQAAELPDFTQLVEQASPAVVNISTTQKLPDRKVSNQQMPDLEGLPPMLREFFERGMPQQRAPRGGGGGQREAQSLGSGFIISPDGYILTNNHVIADADEILVRLADRSELKAKLVGTDPRSDVALLKIEGKDLPVLKLGKSQDLKAGQWVVAIGSPFGFDHTVTQGIVSAIGRSLPNENYVPFIQTDVPINPGNSGGPLFNLAGEVVGINSQIYTRSGGFMGVSFAIPIDVAMDVSNQLKSGGKVSRGWLGVVIQEVNKDLAESFGLDKPAGALVAQIQDDGPAAKGGLQVGDVILSMNGQPIIMSADLPHLVGALKAGSKAKLEVIREGKRQTVELTVGAIPEEGATLDALGNAKPGAERSSNRLGIAVAELTDEQKKTFDLKSGVVIKEVQDGPASLIGLQPGDVITHLNNQAIDTTKQFTDIAKALPKNRSVSMRVLRQGRASFITFKLAE

SEQ ID NO: 3336 - protein, 475 aa, Pseudomonas sp.
MSIPRLKTYLSIFATVLVLGQAVPAMAVELPDFTELVEQASPAVVNISTTQKLPERRVMDQQMPDLEGLPPMLREFFERGMPQPRSPGGGRQREAQSLGSGFIISPDGYILTNNHVIADADEILVRLADRSELKAKLIGTDPRSDVALLKIEGKDLPVLKLGKSQNLKAGQWVVAIGSPFGFDHTVTQGIVSAIGRSLPNENYVPFIQTDVPINPGNSGGPLFNLDGEVVGINSQIYTRSGGFMGVSFAIPIDVAMDVSNQLKTEGKVSRGWLGVVIQEVNKDLAESFGLEKPAGALVAQIQEGGPAAKGGLQVGDVILSMNGQPIVMSADLPHLVGALKAGSKANLEVIREGKRTNVELTVGAIPEEGKELDSLAKSGVERSSNRLGVAVAELTPEQKRTLELQGGVVIKEVQEGPAAMIGLQPGDIITHLNNQAIGSAKEFTDIAKALPKNRSVSMRVLRQGRASFITFKLAE

SEQ ID NO: 3337 - protein, 466 aa, Pseudomonas sp.
MSIPRLKSYLSIVATVLVLGQALPAQAVELPDFTQLVEQASPAVVNISTTQKLPDRKVSNQQMPDLEGLPPMLREFFERGMPQPRSPRGGGGQREAQSLGSGFIISPDGYILTNNHVIADADEILVRLADRSELKAKLIGTDPRSDVALLKIDGKDLPVLKLGKSQDLKAGQWVVAIGSPFGFDHTVTQGIVSAIGRSLPNENYVPFIQTDVPINPGNSGGPLFNLAGEVVGINSQIYTRSGGFMGVSFAIPIDVAMDVSNQLKSGGKVSRGWLGVVIQEVNKDLAESFGLDKPAGALVAQIQDNGPAAKGGLKVGDVILSMNGQPIIMSADLPHLVGALKAGGKAKLEVIRDGKRQNVELTVGAIPEEGATLDALGNAKPGAERSSNRLGIAVVELTAEQKKTFDLQSGVVIKEVQDGPAALIGLQPGDVITHLNNQAIDTTKEFADIAKALPKNRSVSMRVLRQ

SEQ ID NO: 3338 - protein, 462 aa, Pseudomonas sp.
MSIPRLKSYLSIVATVLVLGQAVTAQAAELPDFTQLVEQASPAVVNISTTQKLPERKVSNQQMPDLEGLPPMLREFFERGMPQPRSPRGGGGGQREAQSLGSGFIISPDGYILTNNHVIADADEILVRLADRSELKAKLVGTDPRSDVALLKIEGKDLPVLKLGKSQDLKAGQWVVAIGSPFGFDHTVTQGIVSAIGRSLPNENYVPFIPPPPPPVGINSQIYTRSGGFMGVSFAIPIDVAMDVSNQLKAGGKVSRGWLGVVIQEVNKDLAESFGLDKPAGALVAQIQDDGPAAKGGLQVGDVILTMNGQPIVMSADLPHLVGALKAGSKAKLEVIREGKRQNVELTVGAIPEEGQELGALGGKSGAERSSNRLGIAVVELTDEQKKSFDLKSGVVIKEVQDGPAALIGLQPGDVITHLNNQAINSTKEFTDIAKALPKNRSVSMRVLRQGRASFITFKLAE

SEQ ID NO: 3339 - protein, 474 aa, Pseudomonas sp.
MSIPSLKSYLSIFATVLLLGQAVAAQAAELPDFTQLVEQASPAVVNISTTQKLPDRKVSDIQGLEGLPPEIQQFFRGFPQPRSPKGGGRQREAQSLGSGFIISNDGYILTNNHVVADADEILVRLADRSELKAKLVGTDPRSDVALLKIDGKNLPTLKLGKSKDLKPGQWVVAIGSPFGFDHTVTQGIVSAVGRSLPNENYVPFIQTDVPINPGNSGGPLFNLNGEVVGINSQIYTRSGGFMGVSFAIPIDVAMDVSNQLKAGGKVSRGWLGVVIQEVNKDLAESFGLDKPAGALVAQVQDDGPAAKGGLQVGDVILSMNGQPIEMSADLPHLVGALKAGEKAKLEVVREGQRKTIELTVGAIPDEGKEMDSGRSAGAERSSNRLGVSVADLSDEQKKANDLVKGGVVIKEVQDGPAALIGLQPGDVITHLNNQAITDAKQFTEIAKALPKNRSVSMRVLRQGRASFITFKLAE

SEQ ID NO: 3340 - protein, 478 aa, Pseudomonas sp.
MSMPRLKPYLPILAAVMMLGQAVPALADAPLVQLPDFTQLVEQASPAVVNISTTQKLPERRVSSMGQMPDLEGLPPGLRDFFERSMPQAPRSGGGRQREAQSLGSGFIISPDGYVLTNNHVVADADEIIVRLSDRSEMKAKLVGTDPRSDVALLKIEGKNLPVLKLGKSQDLKAGQWVVAIGSPFGFDHTVTQGIISAIGRSLPNESYVPFIQTDVPINPGNSGGPLFNLAGEVVGINSQIYTRSGGFMGVSFAIPIDVAMDVSNQLKSGGKVSRGWLGVVIQEVNKDLAESFGLDKPAGALVAQVLDDGPAAKGGLQVGDVILSMNGQPIVMSADLPHLVGALKAGSKASLEVVRDGKRKTLDLTVGAIPDEGKEMDSPSGAERSSNRLGVSVVDLSEEQKKANDIKGGVIIKDVQDGPAALIGLQPGDVITHLNNQAITDAKQFTDIAKALPKNRSVSMRVLRQGRASFITFKLAE

SEQ ID NO: 3341 - protein, 477 aa, Pseudomonas sp.
MSIPSLKSYLSIFAAVLLLGQTVAAQAAELPDFTQLVEQASPAVVNISTTQKLPDRKVSEQIQGLEGLPPEIQQFFRGFPQPRGKGGGGGGRQREAQSLGSGFIISDDGYILTNNHVVADADEILVRLADRSELKAKLVGTDPRSDVALLKIDGKNLPTLKLGKSKDLKPGQWVVAIGSPFGFDHTVTQGIVSAVGRSLPNENYVPFIQTDVPINPGNSGGPLFNLNGEVVGINSQIYTRSGGFMGVSFAIPIDVAMDVSNQLKSGGKVSRGWLGVVIQEVNKDLAESFGLDKPAGALVAQVQDDGPAAKGGLQVGDVILSMNGQPIELSADLPHLVGALKAGEKAKLEVVREGQRKTIDLTVGAIPDEGKEMDIAKSAGAERSSNRLGVSVADLTDDQKKANDQLKGGVVIKEVQDGPAALIGLQPGDVITHLNNQAITDAKQFTDIAKALPKNRSVSMRVLRQGRASFITFKLAE

SEQ ID NO: 3342 - protein, 471 aa, Pseudomonas sp.
MPRLKSYLPIFAAVMMLGQAVPALAEAQLPDFTQLVEQASPAVVNISTTQKLPDRKVSSMQMPDLEGLPPGLRDFFERSMPPGGGQGGRQREAQSLGSGFIISPDGYILTNNHVVADADEIIVRLSDRSEMKAKLVGTDPRSDVALLKIEGKNLPVLKLGKSQDLKAGQWVVAIGSPFGFDHTVTQGIISAIGRSLPNESYVPFIQTDVPINPGNSGGPLFNLAGEVVGINSQIYTRSGGFMGVSFAIPIDVAMDVSNQLKTGGKVSRGWLGVVIQEVNKDLAESFGLDKPAGALVAQVLDNGPAAKGGLQVGDVILSMNGQPIVMSADLPHLVGALKAGSKATLEVIRNGKRQTLDLTVGAIPDEGKELAGTTGAEQSSNRLGVSVSDLSDEQKKANDIKGGVIIKDVQDGPAALIGLQPGDVITHLNNQAISDAKQFTEIAKSLPKNRSVSMRVLRQGRASFITFKLAE

SEQ ID NO: 3343 - protein, 471 aa, Pseudomonas sp.
MPRLKSYLPIFAAVLMLGQAVPVMAEAQLPDFTQLVEQASPAVVNISTTQKLPERRVSSMGQMPDLEGLPPGLREFFERSMPPAGKGGRQREAQSLGSGFIISPDGYILTNNHVVADADEIIVRLSDRSEMKAKLVGTDPRSDVALLKIEGKNLPVLKLGKSQDLKAGQWVVAIGSPFGFDHTVTQGIISAMGRSLPNESYVPFIQTDVPINPGNSGGPLFNLAGEVVGINSQIYTRSGGFMGVSFAIPIDVAMDVANQLKAGGKVSRGWLGVVIQEVNKDLAESFGLEKPAGALVAQVLDNGPAAQGGLQVGDVILSMNGQPIVMSADLPHLVGALKAGSKATLEVIRDGKRKNLDLTVGAIPDDAKDIASGNGAEQSSNRLGVSVADLSEEQKKANDIKGGVIITDVQDGPAALIGLQPGDVITHLNNQAISNGKEFTEIAKALPKNRSVSMRVLRQGRASFITFKLAE

SEQ ID NO: 3344 - protein, 471 aa, Pseudomonas sp.
MPRLKSYLPIFAAVLMLGQAVPVMAEAQLPDFTQLVEQASPAVVNISTTQKLPERRASSLGQMPDLEGLPPGLRDFFERSIPPSGKGGRQREAQSLGSGFIISPDGFILTNNHVVADADEIIVRLSDRSEMKAKLVGTDPRSDVALLKIEGKNLPVLKLGKSQDLKAGQWVVAIGSPFGFDHTVTQGIISAIGRSLPNESYVPFIQTDVPINPGNSGGPLFNLAGEVVGINSQIYTRSGGFMGVSFAIPIDVAMDVANQLKAGGKVSRGWLGVVIQEVNKDLAESFGLEKPAGALVAQVLDNGPAAKGGLQVGDVILSMNGQPIVMSADLPHLVGALKAGSKATLEVIRDGKRKNLDLTVGAIPDDAKDIASGAGAEQSSNRLGVSVADLSEEQKKANDIKGGVIITDVQDGPAALIGLQPGDVITHLNNQAINNGKEFTEIAKALPKNRSVSMRVLRQGRASFITFKLAE

SEQ ID NO: 3345 - protein, 476 aa, unknown
  environmental sample
MSIPRLKSYLTMFAAVLMLGQVLTAQAEEALPDFTTLVEQASPAVVNISTKQKLPDRVAAGQMPDLEGLPPMFREFFERNMPQQPRSPRGDRQREAQSLGSGFIISSDGYVLTNNHVVADADEIIVRLSDRSELQAKLVGTDPRTDVALLKVEGKNLPTVKLGDSEKLKVGEWVLAIGSPFGFDHSVTKGIVSAKGRTLPNDTYVPFIQTDVAINPGNSGGPLFNMKGEVVGINSQIFTRSGGFMGLSFAIPIDVAIDVSNQLKKDGKVSRGWLGVVIQEVNKDLAESFGLEKPAGALVAQVLENGPAAKGGLQVGDVILSMNGQPIVMSADLPHLVGGLKDGEKAKLEIIRNGKRQTLDISVGALPDDDADIGTGADGSAERSSNRLGVSVADLTAEQKKSLELKGGVVIKEVQDGPAALIGLRPGDVISHLNNQAIGSAKEFTEIAKELPKNRSVSMRVLRQGRASFITFKLAE

SEQ ID NO: 3346 - protein, 475 aa, unknown
  environmental sample
MSIPRLKSCFSLMAAVLMLGQIAAVQAEDLPDFTGLVEQASPAVVNISTRQKMPERALAGQGADLEGLPPMLREFLERSVPPGSRSPGRGDRQREAQSLGSGFIISDDGYVLTNNHVVDGADEILVRLSDRSELKAKLVGTDPRTDVAVLKIEGKNLPTAKLGNSNTLKVGEWVLAIGSPFGFDHSVTKGIVSAKGRSLPNDTYVPFIQTDVAINPGNSGGPLFNMKGEVVGINSQIFTRSGGFMGLSFAIPIDVAMDVANQLKSSGKVNRGWLGVVIQEVNKDLAESFGLERPAGALVAQVLEDSPAAKGGLRVGDVILTANGQPIVMSADLPHLIGNLKDGSKAELEVIRDGKRQTVNVTVGALPDEGQEMGVPGAGVERSSNRLGVSVIELTAEQKKSLELKGGVVIKEVQGGPAALIGLQSGDVLTHLNNQEIVSAKQFAEVAKSLPKNRSVSMRVLRQGRASFITFKLAE

SEQ ID NO: 3347 - protein, 467 aa, Pseudomonas sp.
MMVATVLMLGQALTAQADEALPDFTTLVEQASPAVVNISTKQKLPDRRVAQGQMPDLEGLPPMFREFFERNMPQQPRSPRGDRQREAMSLGSGFIISSDGYVLTNNHVVADADEIIVRLSDRSELQAKLIGTDPRTDVALLKVDGKNLPTVKLGDSEKLKVGEWVLAIGSPFGFDHSVTKGIVSAKGRTLPNDTYVPFIQTDVAINPGNSGGPLFNMKGEVVGINSQIFTRSGGFMGLSFAIPIDVALDVSNQLKKDGKVSRGWLGVVIQEVNKDLAESFGLDKPAGALVAQVLENGPAAKGGLQVGDVILSMNGQPIVMSADLPHLVGSLKDGEKAKLEIIRNGKRQTLDVAVGAMPDDDADITAGADGSTERSSNRLGVAVADLTAEQKKSLELKGGVVIKEVQDGPAALIGLRPGDVISHLNNQAIGSAKEFTEIAKELPKNRSVSMRVLRQGRASFITFKLAE

SEQ ID NO: 3348 - protein, 479 aa, Pseudomonas sp.
MLIPSFKSYLSLMAAVLMLGQVATAQAEALPDFTTLVEQASPAVVNISTRQKLPDRAVAGQMPDLEGLPPMLREFLERSMPNQGPRAPGSPKGDRQREAQSLGSGFIISADGYVLTNNHVVEGADEILVRLSDRSELKAKLVGTDPRTDVAVLKIEGKDLPTVKLGDSEKLKVGEWVLAIGSPFGFDHSATKGIVSAKGRSLPNDTYVPFIQTDVAINPGNSGGPLFNMSGEVVGINSQIFTRSGGFMGLSFAIPINVAMDVANQLKASGKVNRGWLGVVIQEVNKDLAESFGLDKPAGALVAQVLEDGPAAKGGLQVGDVILNANGHPIVMSADLPQIVGNLKDGSKVQLDVIREGKRKMLDVTVGALPDEGQEMGAADGAGAERSSNRMGVTVADLTAEQQKSLDLKGGVIIKEVQEGPASLIGLQPGDVITHLNNQAISSAKNFTEVAKGLPKNRSVSLRVLRQGRASFITFKLAE

SEQ ID NO: 3349 - protein, 500 aa, Pseudomonas sp.
MRSLSQLLVLLNFLLVTNGSYMSIPRMKSYFSLIAAVLMLGQVATAQAENLPDFTGLVEQASPAVVNISTRQKLPDRAIANQQMPDLEGLPPMLREFLERSMPPGSRPPGAGKGDRQREAQSLGSGFIISPDGYILTNNHVIDGADEILVRLSDRSELKAKLIGTDSRTDVAVLKIDGKDLPTAKLGNSNTLKVGEWVLAIGSPFGFDHSVTKGIVSAKGRSLPNDTYVPFIQTDVAINPGNSGGPLFNMAGEVVGINSQIFTRSGGFMGLSFAIPIDVAMDVANQLKASGKVSRGWLGVVIQEVNKDLAESFGLDKPAGALVAQVLEDGPAAKGGLQVGDVILSANGQPIIMSADLPHLIGNLKDGSKAELEVIRDGKRQKLTVTVGALPDEGQEMGDVAGTGAERSSNRLGVSVIELTAEQKKSLDLKGGVAIKEVTGGPASLIGLQPGDVITHLNNQAITSSKQFTEVAKSLPKDRSVSMRVLRQGRATFITFKLSE

SEQ ID NO: 3350 - protein, 470 aa, Pseudomonas sp.
MPRLKSCLSVVAGLVLLGQTLVANAQLPDFTPLVEQAAPAVVNISTRQKIPDRLAGAQIPDLEGLPPIFREFFERSFPPGLGKPGGGRQREAQSLGSGFIISRDGYVLTNNHVVADADEIIVRLSDRSELQAKLVGADPRSDVALLKVDGKNLPTVKVGSANDLKVGEWVLAIGSPFGFDHSVTAGIVSAKGRSLPNESYVPFIQTDVAINPGNSGGPLFNLNGEVVGINSQIFTRSGGFMGLSFAIPIDVAMDVANQLRTEGKVSRGWLGVVIQEVNKDLAESFGLDKPAGALVAQIMEGGPADKSGLQVGDVILSMNGQPIVMSADLPHLVGALKPGSKASMEIVRKGSRKTLNVTVGALPAEGEELASIQGGERSSNRLGVVVAELSSEQKRVLDIRGGVVIKEVQNGPAALIGLRPGDIITHLNNQAIDSTATFAKVAQALPKNRSVSMRVLREGRASFITFKLAE

SEQ ID NO: 3351 - protein, 477 aa, unknown
  environmental sample
MSIPRMKSYFSLIAAVLMLGQVATAQAENLPDFTGLVEQASPAVVNISTRQKLPDRAVANQQMPDLEGLPPMLREFLERSMPPGSRPPGSGAGKGDRQREAQSLGSGFIISPDGYVLTNNHVIDGADEILVRLSDRSELKAKLVGTDPRTDVAVLKIDGKDLPTAKLGNSNTLKVGEWVLAIGSPFGFDHSVTKGIVSAKGRSLPNDTYVPFIQTDVAINPGNSGGPLFNMAGEVVGINSQIFTRSGGFMGLSFAIPIDVAMDVANQLKANGKVSRGWLGVVIQEVNKDLAESFGLDKPAGALVAQVLEDGPAAKGGVQVGDVILSANGQPIVMSADLPHLIGNLKDGSKAELEVIRDGKRQKLTVTVGALPDEGQEMGDVGGTGAERSSNRLGVSVIELTAEQKKSLDLKGGVAIKEVTGSPASLIGLQAGDVITHLNNQARPPPATTADSVAVLLAGPRAYRHSAASVRARSMTV

SEQ ID NO: 3352 - protein, 474 aa, unknown
  environmental sample
MHTLKRCMAAMVALLALSLAMTARAELPDFTPLVEQASPAVVNISTRQKLPDRAMARGQLSIPDLEGLPPMFRDFLERSIPQVPRNPRGQQREAQSLGSGFIISNDGYILTNNHVVADADEILVRLSDRSEHKAKLVGADPRSDVAVLKIEAKNLPTLKLGDSNKLKVGEWVLAIGSPFGFDHSVTAGIVSAKGRSLPNESYVPFIQTDVAINPGNSGGPLLNLQGEVVGINSQIFTRSGGFMGLSFAIPIDVALNVADQLKKAGKVSRGWLGVVIQEVNKDLAESFGLDKPSGALVAQLVEDGPAAKGGLQVGDVILSLNGQSINESADLPHLVGNMKPGDKINLDVIRNGQRKSLSMAVGSLPDDDEEIASMGAPGAERSSNRLGVTVADLTAEQRKSLDIQGGVVIKEVQDGPAAVIGLRPGDVITHLDNKAVTSTKVFADVAKALPKNRSVSMRVLRQGRASFITFKLAE

SEQ ID NO: 3353 - protein, 473 aa, Azotobacter sp.
MSKVGFKSFASVLAGALLLGQSLFVQAQLPEFTSLVEEASPAVVNISTRQKLPDRSTVQGLPDLEGLPPLFREFLERSIPQLPRTPDNGRQREAHSLGSGFIISPDGYVLTNNHVVADADEIIVRLSDRSELEAELVGADPLTDVALLKVKGSNLPTVKLGRTDQLRVGEWVLAIGSPFGFDHSVTAGIISATGRSLPNESYVPFIQTDVAINPGNSGGPLFDLDGRVIGINSQIFTRSGGFMGLSFAIPIEVAMGVADQLKATGKVARGWLGVIIQEVNKDLAESFGLDRPAGALVAQVLEDGPADKGGLQVGDVILSLDGHPIVMSADLPHLVGGLKPGAAANLEVVRDGKRRNIAITVGALPEEGNGVQPSIAGTEQSSNRLGVTVTELTAEQKKSLDLKGGVVIREVLNGPAALIGLRPGDVVTHLNNQPIDSAKTFAEVAGALPKGRSVSMRVLRQGRASFITFKLAE

SEQ ID NO: 3354 - protein, 469 aa, Pseudomonas sp.
MILRRNFLAAVAGVALFGQTLMAHAELPDFTPLVEDASPAVVNISTKQKQPMRGNAQAQMPDLEGIPPMFREFFEHGMPQQPERRREAQSLGSGFIISEDGYVLTNNHVVADADEIMVRLPDRSEMQAKLVGADPRSDVALLKIEGDGLPTVKIGSSDELKAGEWVVAIGSPFGFDHTVTAGVVSAKGRSLPNESYVPFIQTDVAINPGNSGGPLFNLEGEVVGINSQIFTRSGGFMGLSFAIPIDVAMDVANQLREDGKVSRGWLGVVIQEVNKDLAESFGLERPAGALVAQVMDGGPAAKGGLKVGDVILSVNGKSIDMSGDLPHLIGAMKPDSKAKLEVVRDGQRKTLTIDIGALPEDGTIMASADGSGGNSQSNNRLGVSVAELTDAQRQALEVSGGVVIRDISQGPAAMIGLRPGDVITHLNNEAIDSVQQFSQVVKDLPKNRSVSMRVLREGRASFITFKLPK

SEQ ID NO: 3355 - protein, 385 aa, Pseudomonas sp.
MDANDNAFILDKRGVLKFFANKLAPTEGRRSVRERSFRDSSRAGSIWMPPFFVQEIMQSSSNLFPVALISAERRGDLSEDVYRLKPGNSPDFTVELAVTRLGMADESSSRGVPVILLHGSFSNRRFWFSPKGLGLGAYLARQGFDVWIPEMRGHGLSQRNHDYRKNRVADYARYDLPAIGAFVREQSGQVPHWIGHSLGGTTLAAALGGEYIGEPVVASAAFFGTQVSRTYWPLKIPPVEWSGRFILKRFAQLSGSRLKRGPEDEPIGLALESMRWFGLFGRFGDADKDWWAGLAEVKLPVLAVSAAGDHQDPAWACRKLFEQFGSEHKQFINLGREQGFGDNFGHVEMLVSKAAQAEVWPLVTRWLADQQTPLPGAQQDLVVAV

SEQ ID NO: 3356 - protein, 338 aa, Pseudomonas sp.
MPPFFVQEIMQSSSNLFPVALISAERRGDLSEDVYRLKPGNSPDFTVELAVTRLGMADESSSRGVPVILLHGSFSNRRFWFSPKGLGLGAYLARQGFDVWIPEMRGHGLSQRNHDYRKNRVADYARYDLPAIGAFVREQSGQVPHWIGHSLGGTTLAAALGGEYIGEPVVASAAFFGTQVSRTYWPLKIPPVEWSGRFILKRFAQLSGSRLKRGPEDEPIGLALESMRWFGLFGRFGDADKDWWAGLAEVKLPVLAVSAAGDHQDPAWACRKLFEQFGSGHKQFINLGREQGFGDNFGHVEMLVSKAAQAEVWPLVTRWLADQQTPLPGAQQDFAAAI

SEQ ID NO: 3357 - protein, 338 aa, Pseudomonas sp.
MPPFFVQEIMQSSSNLFPVALISAERRGDLSEDVYRLKPGNSPDFTVELAVTRLGMADESISRGVPVILLHGSFSNRRFWFSPKGLGLGAYLARQGFDVWIPEMRGHGLSQRNHDYRKNRVADYARYDLPAIGAFVREQSGQVPHWIGHSLGGTTLAAALGGEYIGEPVVASAAFFGTQVSRTYWPLKIPPVEWSSRFILKRFAQLSGSRLKRGPEDEPIGLALESMRWFGLFGRFGDADKDWWRGLAEVKLPILAVSAAGDHQDPAWACRKLFEQFGSEHKQFINLGREQGFADNFGHVEMLVSKAAQAEVWPLVTRWLADQQTLLPGAQQDLAAAI

SEQ ID NO: 3358 - protein, 338 aa, unknown
  environmental sample
MPPFFVQEIMQSSSNLFPVALISAERRGDLSEDVYRLKPGNSPDFTVELAVTRLGMADEPSSRGVPVILLHGSFSNRRFWFSPKGLGLGAYLARLGFDVWIPEMRGHGLSQRNHDYRKNRVADYARYDLPAIGAFVREQSGQVPHWIGHSLGGTTLAAALGGEYIGEPVVASAAFFGTQVSRTYWPLKIPPVEWSSRFILKRFAQLSGARLKRGPEDEPIGLALESMRWFGLFGRFGDADKDWWAGLAEVRLPVLAVSAAGDHQDPAWACRKLFEQFGSEHKQFINLGRDQGFSDNFGHVEMLVSKPAQAEVWPLVTRWLADQQTPLLGEQGDLAAAV

SEQ ID NO: 3359 - protein, 329 aa, Pseudomonas sp.
MQSSSNLFPVALISAERRGDLSEDVYRLKPGNSPDFTVELAVTRLGMADGSSSRGVPVILLHGSFSNRRFWFSPKGLGLGAYLARLGFDVWIPEMRGHGLSQRNHDYRKNRVADYARYDLPAIGAFVREQSGQVPHWIGHSLGGTTLAAALGGEYIGEPVVASAAFFGTQVSRTYWPLKIPPVEWSGRFILKRFAQLSGSRLKRGPEDEPIGLALESMRWFGLFGRFGDADKDWWAGLAEVKLPVLAVSAAGDHQDPAWACRKLFEQFGSEHKQFINLGREQGFGDNFGHVEMLVSKAAQAEVWPLVTRWLADQQTPLPGAQQDLAAAI

SEQ ID NO: 3360 - protein, 379 aa, Pseudomonas sp.
MVVNDNAYLLDKRVVLTSFASRLAPTLAGSFRYSSRAGSSGCRPFLCKSIMQSSSNLFPVALISAERRGDLSEDVYRLKPGNSPDGTVELAVTRLGLADEPTVRGVPVILLHGSFSNRRFWFSPKGLGLGAYLTRLGFDVWIPEMRGHGLSQRNQDYRKNRVADYARYDLPAIGAFVREQSGQVPHWIGHSLGGITLAAALGGEYIGEPVVASAAFFGTQVSRTYWPLKFPPVEWSGRFILKRFAQLSGSRLKRGPEDEPIGLALESMRWYGLFGRFGDADKDWWAGLAEIQLPVLAVSAAGDHQDPTWACRKLFDQVGSEHKQFITLGREQGFGDNFGHVEMLVSKSAQTEVWPLVARWLADQQTPLLGEKPDLASAV

SEQ ID NO: 3361 - protein, 379 aa, Pseudomonas sp.
MVVNDNAYSLDKRVVLASFASRLAPTLAGSFRYSSRAGSSGCRPFLCKSIMQSSSNLFPVALISAERRGDLSEDVYRLKPGNSPDGTVELAVTRLGLADEPAVRGVPVILLHGSFSNRRFWFSPKGLGLGAHLTRLGFDVWIAEMRGHGLSQRNQDYRNNRVADYARYDLPAIGAFVREQSGQIPHWIGHSLGGITLAAALGGEYIGEPVVASAAFFGTQVSRTYWPLKFPPVEWSGRFILKRFAQLSGSRLKRGPEDEPIGLALESMRWYGLFGRFGDADKDWWAGLAEVQLPVLAVSAAGDHQDPTWACRKLFDQVGSEHKQFITLGREQGFSDNFGHVEMLVSKAAQTEVWPLVARWLADQQTPLLGGKPDLDAAV

SEQ ID NO: 3362 - protein, 338 aa, Pseudomonas sp.
MPPFFVQEIMQSSSNLFPVALISAERRGDLSEDVYRLKPGNSPDGTVELAVTRLGMADESASRGVPVILLHGSFSNRRFWFSPKGLGLGAYLTRLGFDVWIAEMRGHGLSRRNQNYRKNRVADYARYDLPAIGAFVREQSGQVPHWIGHSLGGITLAAALGGQHIGEPVVASAAFFGTQVSRTYWPLKIPPVEWSGRFILKRFAQLSGSRLKRGPEDEPIGLALESMRWYGLFGRFGDADKDWWAGLAEVRMPVLAVSAAGDHQDPAWACRKLFDQLGSEHKQFINLGREQGFADNFGHVEMLVSKAAQAEVWPLVARWLVDQQTPLLGDQADLAAAI

SEQ ID NO: 3363 - protein, 331 aa, Pseudomonas sp.
MQSSSNLFPVALISAERRGDLSEDVYRLKPGNSPDFTVELAVTRLGLADEPSSRGVPVILLHGSFSNRRFWFSPKGLGLGAYLARLGFDVWIPEMRGHGLSQRNHDYRKNRVADYARYDLPAIGAFVREQSGQVPHWIGHSLGGITLAAALGGEYIGEPVVASAAFFGTQVSRNYWPLKIPPVEWGGRFILKRFAQLSGSRLKRGPEDEPIGLALESMRWYGLFGRFGDADKNWWAGLAEVKLPVLAVSAAGDHQDPAWACRKLFDQLGSGHKQFINLGRDQGFADNFGHVEMLVSKPAQAEVWPLVARWLADQQTPLLGEQRDLAAAIRA

SEQ ID NO: 3364 - protein, 329 aa, Pseudomonas sp.
MQSSSNLFPVALISAERRGDLSEDVYRLKPGNSPDGTVELAVTRLGMADEPASRGVPVILLHGSFSNRRFWFSPKGLGLGAYLARLGFDVWIAEMRGHGLSRRNQSYRKNRVADYARYDLPAIGAFVREQSGQVPHWIGHSLGGITLAAALGGQYIGEPVVASAALFGTQVSRTYWPLKIPPVEWSGRFILKRFAQLSGSRLKRGPEDEPIGLALESMRWYGLFGRFGDADKDWWAGLAEVRMPVLAVSAAGDHQDPAWACRKLFDQLGCEHKQFINLGREQGFADNFGHVEMLVSKAAQAEVWPLVARWLSDQQTPLLGDQADLAAAI

SEQ ID NO: 3365 - protein, 329 aa, Pseudomonas sp.
MQSSSNLFPVALISAERRGDLSEDVYRLKPGNSPDWSVEIAVTRLGMADEPASRGVPVILLHGSFSNRRFWFSPKGLGLGAYLTRLGFDVWIPEMRGHGLSQRNEDYRRNRVADYARYDLPAIAAFVREQSGQIPHWIGHSLGGITLAAALGGEYLGEPAVASAAFFGTQVSRTYWPLKIPPVEWSGRFILKRFAQLSGSRLKRGPEDEPIGLALESMRWYGLFGRFGDKDKDWWAGLADVQVPVLAVSAAGDHQDPAWACRKLFEQIGSEHKQFINLGREQGFNDQFGHVEMLVSKAAQAEVWPLVARWLADQHTPLLGEKPDLAAAV

SEQ ID NO: 3366 - protein, 331 aa, Pseudomonas sp.
MQSSSHLFPVALISAERRGDLSEDVYRLKPGNSPDGTVELAVTRLGMADEPAVRGVPVILLHGSFSNRRFWFSPKGLGLGAYLARQGFDVWIAEMRGHGLSQRNQNYRNNRVADYARYDLPAIGAFVREQSDQVPHWIGHSLGGITLAAALGGEYIGESVVASAAFFGTQVSRTYWPLKFPPVEWSGRFILKRFAQLSGSRLKRGPEDEPIGLALESMRWYGLFGRFGDADKDWWAGLADVQLPVLAVSATGDHQDPAWACRKLFDQLGSELKQFITLGREQGFGDNFGHVEMLVSKAAQTEVWPLVARWLADQRTPLLGEKSDFATAIQA

SEQ ID NO: 3367 - protein, 329 aa, Pseudomonas sp.
MQSSSNLFPVALISAERRGDLSEDVYRLKPGNSPDWSVEIAVTRLGMADDSAPRGVPVILLHGSFSNRRFWFSPKGLGLGAYLTRLGFDVWIPEMRGHGLSQRNEEYRRNRVADYARYDLPAIAAFVREQSGQIPHWIGHSLGGITLAAALGGEYLGEPAVASAAFFGTQVSRTYWPLKIPPVEWSSRFILKRFAQLSGSRLKRGPEDEPIGLAIESMRWYGLFGRFGDKDKDWWAGLADVQVPVLAVSAAGDHQDPTWACRKLFEQIGAEHKQFINLGRDQGFNDNFGHVEMLVSKAAQVEVWPLVARWLSDQQTPLLGEKPDLAAAV

SEQ ID NO: 3368 - protein, 329 aa, Pseudomonas sp.
MQSSSNLFPVALISAERRGDLSEDVYRLKPGNSPDYSVELAVTRLGMADACEVRGVPVILLHGSFSNRRFWYSPKGLGLGAYLARLGFDVWIPEMRGHGLSQRNQGYRNNRVADYARYDLPAIGAFVREQSGQVPHWIGHSLGGITLAAALGGHYLGAPAVASAAFFGAQVSRTYWPLKIPPVEWSGRFILKRFAQLSGSRLKRGPEDEPIGLALESMRWYGLFGRFGDAEKNWWAGLADVQVPVLAVSAAGDQQDPTWACRKLFDQIGSEHKQFVCLGREQGFGDDFGHVEMLVSKAAQAEVWPLVARWLDDQGAPLLADQPRLAQAV

SEQ ID NO: 3369 - protein, 329 aa, Pseudomonas sp.
MQSSSNLFPVALISAERRGDLSEDVYRLKPGNSPDTTVELAVTRLGMADEPESRGVPVILLHGSFSNRRFWYSPKGIGLGAYLARMGFDVWIPEMRGHGLSRRNADYRKNRVADYAQYDLPAIGAFVREQSGQVPHWIGHSLGGITLAAALGGQYLGEPAVASAALFGCQVSRTYWPLKIPAVEWGGRFILKRFAQLSGSRLKRGPEDEPIGLALEGMRWYGLFGRFGDGQKDWWAGLSDVSLPVLAVSAAGDHQDPTWACRKLFDQLSSDHKQFVCLGREQGFSGNFGHVEMLVSKAAQAEVWPLVARWLKDQQSPLLASSAELAAAS

SEQ ID NO: 3370 - protein, 329 aa, Pseudomonas sp.
MQSSSNLFPVALISAERRGDLCEDVYRLKPGNSPDYSVELAVTRLGMADATETRGVPVILLHGSFSNRRFWYSPKGLGLGAYLTRLGFDVWIPEMRGHGLSQRNQGYRNNRVADYARYDLPAIGAFVREQSGQVPHWIGHSLGGITLAAALGGHYLGAPAVASAAFFGTQVSRTYWPLKIPPLEWSGRFILKRFAQLSGARLKRGPEDEPIGLALESMRWYGLFGRFGDAEKNWWAGLADVQVPVLAVSAAGDHQDPTWACRKLFEQIGSEHKQFVCLGRKQGFSDDFGHVEMLVSKAAHTEVWPLVARWLEDQHAPLLENLPVLAEAV

SEQ ID NO: 3371 - protein, 329 aa, Pseudomonas sp.
MQSSSNLFPVALISAERRGDLSEDVYRLKPGNSPDPSVELAVTRLGLADEPEARGIPVVLLHGSFSNRRFWYSPKGIGLGAYLARAGFDVWIPEMRGHGLSRRNADYRKNRVADYARYDLPAIAAFVREQSAQVPHWIGHSLGGTTLAAALGGQYLGDAGVASAAFFGTQISRTYWPLKIPMVEWGGRLVIKRFAQLSGSRLKRGPEDEPIGLALESMRWHGLFGRFGDADKDWWAGLAQVTVPALAVSAAGDHQDPTWACRKLFEQLGSEQKQFVCLGREQGFSGNFGHVEMLVSKSAQTEVWPLVACWLKDQQAPLLVSVAEPVAAV

SEQ ID NO: 3372 - protein, 329 aa, Pseudomonas sp.
MQSSSNLFPVALISAERRGDLSEDVYRLKPGNSPDGTVELAVTRLGLADVAQSRGIPVVLVHGSFSNRRFWYSPKGIGLGAYLARQGFDVWIPEMRGHGLSRRNHDYAKNRVADYARYDLPAIAAFVLEQSAQIPHWIGHSLGGTTLAAALGGQYLGAPAVASVALFGCQVSRTYWPLKIPPVEWGGRLILKRFAQLSGSRLKRGPEDEPIGLALESMRWHGLFGRFGDAERDWWKGLAEVDVPLLAVSAAGDHQDPDWACRKLFDQVGSEHRQYLCLGRKQGFSGDFGHVEMLVSKAAQAEVWPLVQRWLNDPLTPLVGSQAPVLGSI

SEQ ID NO: 3373 - protein, 329 aa, Pseudomonas sp.
MQSSSDLFPVALLSAERRGDLSEDVYRLKPGNSPDLTVELAVTRLGLADEPQARGVPVILLHGSFSNRRFWFSPKGIGLGAYLARAGFDVWVAEMRGHGLSVRNQDYRKNRVADYARYDLPAIAAFVREQSGQIPHWIGHSLGGTTLAAALGGLYLGAPAVASAALFGCQVSRTYWPLKIPPVEWSGRLLLKRFAHLSGSRLKRGPEDEPIGLALESMRWYGLFGRFGDKERNWWEGLAEVDVPVLAVSAEGDRQDPAWACRKLFEQIGSPLKRFICLGREAGFSSPFGHVEMLVSKPAQAEVWPLVADWLRDPQAFLPVQSAEVQPAL

SEQ ID NO: 3374 - protein, 329 aa, Pseudomonas sp.
MQSSSDLFPVALLSAERRGDLSEDVYRLKPGNSPDASVELAVTRLGMADEPQARGVPVILLHGSFSNRRFWFSPKGVGLGAYLARAGFDVWVPEMRGHGLSVRNQDYRKNRVADYARYDLPAIAAFVREQSGQIPHWIGHSLGGTTLAAALGGQHLGAPAVASAALFGSQVSRTYWPLKIPVVEWSGRFLLKRFAHLSGSRLKRGPEDEPIGLALESMRWYGLFGRFGDKERNWWEGLAEVDVPVLAVSAEGDRQDPAWACRKLFEQIGSPLKRFICLGRAAGFSSAFGHVEMLVSKPAQTEVWPLVADWLRDQQAFMAPQSGEVQQAS

SEQ ID NO: 3375 - protein, 329 aa, Pseudomonas sp.
MQSSSNLFPVALISAERRGDLSEDVYRLKPGNSPDGTVELAVTRLGLADVPENRGVPVVLLHGSFSNRRFWYSPKGIGLGAYLAREGFDVWIPEMRGHGLSRRNQDYARNRVADYARYDLPAIAAFVREQSGQIPHWIGHSLGGTTLAAALGGQHLGAPAVASVALFGCQVSRTHWPLKLPPVEWTGRLLLKRFGQLSGARWKRGPEDEPAGVLIEAMRWNGLFGRFGEGKQDWWKGLAEVDVPLLAVSAAGDHQDPDWACRKLFEQVGSGHRQYLCLGRQQGFSGDFGHVEMLVSKAAQAEVWPLVTRWLKNPLTPLLGAQAQELAAV

SEQ ID NO: 3376 - protein, 329 aa, unknown
  environmental sample
MQSSSNLFPVALISAERRGDLSEDVYRLKPGNSPDGTVELAVTRLGLADVPENRGIPVILLHGSFSNRRFWYSPKGIGLGAYLARLGFDVWIPEMRGHGLSKRNHDYVRNRVADYARYDLPAIGAFVREQSAQVPHWIGHSLGGISLAAALGGRHLGAPAVASVALFGCQVSRTHWPLKLPPVEWTGRLLLKRFGELSGSRFKRGPEDEPAGVLIEAMRWNGLFGRFGEGKHDWWKGLAEVEVPLLAVSAAGDHQDPDWACRKLFEQVGSEHRQYLCLGRQQGFIGDFGHVEMLVSKAAQAEVWPLVAQWLNDPFTPLFATPAEVVATV

SEQ ID NO: 3377 - protein, 341 aa, Pseudomonas sp.
MRKSLLALLLVGWAGFGQAQVPLREGYPQRYTVVAGDTLWSIANRFLRDPWQWPALWQANSSLADPDLIYPGDSLALVQVNGEPRLTLERGASRGTVKLSPQVRRTPLAEAIPTIPLQAIDSFLLSNRILDRAETFDSAPYIVAGDAERVLSGTGDRIFARGRFDPEQSAYGIFRQGKTYTDPQSGEVLGINADEIGGGEVVAVEGDIATLQLQRTTQEVRLGDRLFSGEPRVINSTFVPSPPSRAVEGLIIDVPRGVTQIGALDVVTLNKGRRDGLAEGNVLAVLKTGETVRDRVAGGQVKMPDERAGLLMVFRTYDKLSYGLVLNASRSLAIMDKVRNP

SEQ ID NO: 3378 - protein, 341 aa, Pseudomonas sp.
MRKSLLALLLVGWAGFGQAQVPLREGYPQRYTVVAGDTLWSIANRFLRDPWQWPALWQANSSLADPDLIYPGDSLALVQVNGEPRLTLERGASRGTVKLSPQVRRTPLAEAIPTIPLQAIDSFLLSNRILDRAETFDSAPYIVAGDAERVLSGTGDRIFARGRFDPEQSAYGIFRQGKTYTDPQSGEVLGINADEIGGGEVVAVEGDIATLQLQRTTQEVRLGDRLFSGEPRTINSTFVPSPPSRAVEGLIIDVPRGVTQIGALDVVTLNKGRRDGLAEGNVLAVLKTGETVRDRVAGGQVKMPDERAGLLMVFRTYDKLSYGLVLNASRSLAIMDKVRNP

SEQ ID NO: 3379 - protein, 341 aa, Pseudomonas sp.
MRKSLLALLLVGWAGFGQAQVPLREGYPQRYTVVAGDTLWSIANRFLRDPWQWPALWQANSSLADPDLIYPGDSLALVQVNGEPRLTLERGASRGTIKLSPQVRRTPLAEAIPTIPLQAIDSFLLSNRILDRAETFDSAPYIVAGDAERVLSGTGDRIFARGRFDPEQSAYGIFRQGKTYTDPQSGEVLGINADEIGGGEVVAVEGDIATLQLQRTTQEVRLGDRLFSGEPRTINSTFVPSPPSRAVEGLIIDVPRGVTQIGALDVVTLNKGRRDGLAEGNVLAVLKTGETVRDRVAGGQVKMPDERAGLLMVFRTYDKLSYGLVLNASRSLAIMDKVRNP

SEQ ID NO: 3380 - protein, 341 aa, Pseudomonas sp.
MRKSLLALLLVGWAGFGQAQVPLREGYPQRYTVVAGDTLWSIANRFLRDPWQWPALWQANSSLADPDLIYPGDSLALVQINGEPRLTLERGASRGTLKLSPQVRRTPLVEAIPTIPLQAIDSFLLSNRILDRADAFDSAPYIVAGDAERVLSGTGDRIFARGRFDPEQSAYGIFRQGKTYTDPQSGELLGINADEIGGGEVVAVEGDIATLQLQRTTQEVRLGDRLFSGEPRVINSTFVPSPPSRAVEGLIIDVPRGVTQIGALDVVTLNKGRRDGLAEGNVLAVLKTGETVRDRVAGGQVKMPDERAGLLMVFRTYDKLSYGLVLNASRSLAIMDKVRNP

SEQ ID NO: 3381 - protein, 341 aa, Pseudomonas sp.
MRKSLLALLLVGWAGFGQAQVPLREGYPQRYTVVAGDTLWSIANRFLRDPWQWPALWQANSSLADPDLIYPGDSLALVQINGEPRLTLERGASRGTLKLSPQVRRTALVEAIPTIPLQAIDSFLLSNRILDRADAFDSAPYIVAGDAERVLSGTGDRIFARGRFDPEQSAYGIFRQGKTYTDPQSGELLGINADEIGGGEVVAVEGDIATLQLQRTTQEVRLGDRLFSGEPRVINSTFVPSPPSRAVEGLIIDVPRGVTQIGALDVVTLNKGRRDGLAEGNVLAVLKTGETVRDQVAGGQVKMPDERAGLLMVFRTYDKLSYGLVLNASRSLAIMDKVRNP

SEQ ID NO: 3382 - protein, 341 aa, Pseudomonas sp.
MRKSLLALLLVGWAGVGQAQVPLREGYPQRYTVVAGDTLWSIANRFLRDPWQWPALWQANSSLVDPDLIYPGDSLALVRVNGEPRLTLERGASRGTVKLSPQVRRTPLVEAIPTIPLQAIDSFLLSNRILDRAETFDSAPYIVAGDAERVLSGTGDRIFARGRFDPDQSAYGIFRQGKTYTDPQSGEVLGINADEIGGGEVVAVEGDIATLQLQCTTQEVRLGDRLFSGEQRVINSTFVPSPPSRAVEGLIIDVPRGVTQIGALDVVTLNKGRRDGLAEGNVLAVLKTGETVRDRVAGGQVKMPDERAGLLMVFRTYDKLSYGLVLNASRSLAIMDKVRNP

SEQ ID NO: 3383 - protein, 341 aa, Pseudomonas sp.
MRKSLLALLLVGWAGFGQAQVPLREGYPQRYTVVAGDTLWSIASRFLRDPWQWPALWQANSSLADPDLIYPGDSLALVRVDGEPRLTLERGASRGTVKLSPQVRRTPLVEAIPSIPLQAIDSFLLSNRILDRADAFDSAPYIVAGDAERVLSGTGDRIFARGRFDPEQSAYGIFRQGKTYTDPQSGELLGINADEIGGGEVVAVEGDIATLQLQRTTQEVRLGDRLFGGEPRVINSTFVPSAPSRAVEGLIIDVPRGVTQIGALDVVTLNKGRRDGLAEGNVLAVMKTGETVRDRVAGGQVKMPDERAGLLMVFRTYDKLSYGLVLNASRSLAIMDKVRNP

SEQ ID NO: 3384 - protein, 341 aa, Pseudomonas sp.
MRKSLLALLLMGWAGIGQAQVPLREDHPQRYTVVAGDTLWSIASRFLRDPWQWPALWQANSNVADPSRIYPGDSLALVRVAGEPRLTLERGASHGTLKLSPQVRRTPLAEAIPSIPLQAIDSFLLGNRILEGADAFASAPYVVAGDAERVLSGTGDRIFARGRFDPERPAYGIFRQGKTYTDPQSGELLGINADEIGGGEVVAVEGDIATLRLQRTTQEVRLGDRLFGGEPRAVNATFAPSPPSQAVDGLIIDVPRGVTQIGALDVVTLNKGRRDGLVEGNVLAVMKTGETVRDRVAGGSLKMPDERAGLLMVFRTYDKLSYGLVLNASHSLAVLDKVRNP

SEQ ID NO: 3385 - protein, 341 aa, Pseudomonas sp.
MRKSLLALLLVGWTGIGQAQVALREDYPQRYTVVAGDTLWSIASRYLRDPWQWPALWQANAGLADPDLIYPGDSLTLTRVDGQPRLNLARTASRGTIKLSPEVRRTPLAEAIPSIPLQAVESFLLSNRILDRADAFDRAPYVVAGDAERVLSGTGDRIFARGRFDPEPSTYGIFRRGKTYTDPGSGEVLGINADEIGGGEVVAVEGDIATLRLLRTTQEVRLGDRLFGSEPRTLDPAFVPSPPSRAVEGLIIDVPRGVNQVGALDVVTLNKGRRDGLAQGNVLAVMKTGETVRDRVAGGEVKMPDERAGLLMVFRTYDKLSYGLVLSASRSLAVMDKVRNP

SEQ ID NO: 3386 - protein, 341 aa, Pseudomonas sp.
MRKSLLALLLLASAGLAHGQVQLKEGFPQQYTVVAGDTLWGISGKFLREPWQWPELWQANPQIENPNLIYPGDSLSLVYVNGEPRLTLNRGASRGTIKLSPRVRSSPVAEAIPSIPLKSINSFLLSNRIVDNAEDFDKAPYIVAGDAERVLSGIGDRIFARGHFDPAQPVYGIFRQGKVYTDPQTQEFLGINADDIGGGEIVATEGDVATLALQRTTQEVRLGDRLFSGEERSINSTFMPSAPKTDINGLIIDVPRGVTQIGALDVVTLNKGQRDGLAEGNVLVVMKTGETVRDRITGQPLKIPDERAGLLMVFRTYDKLSYGLVLNASRSLAVMDKVRNP

SEQ ID NO: 3387 - protein, 341 aa, Pseudomonas sp.
MRKSLLALLLLASAGFAHGQVQLREGFPQQYTVVAGDTLWDISAKYLREPWEWPQLWQANPQIENPNLIYPGDTLSLVYVNGQPRLTLNRGASRGTLKLSPRIRSSPVADAIPSIPLKSINSFLLSNRIVDKAEDFDNAPYIVAGDAERVLSGTGDRIFARGHFDPAQPVYGIFRQGKVYTDPQSKEFLGINADDIGGGEIIATEGDVATLALQRTTQEVRLGDRLFSGEERSINSTFMPSAPTTEINGLIIDVPRGVTQIGALDVVTLNKGQRDGLAEGNVLVVMKTGETVRDRITGQPLKIPDERAGLLMVFRTYDKLSYGLVLNASRSLAVMDKVRNP

SEQ ID NO: 3388 - protein, 341 aa, Pseudomonas sp.
MRKSLLALLLLASAGLAHGQVQLKEGFPQQYTVESGDTLWDISGKFLREPWKWPELWQANPQIENPNLIYPGDSLSLVYVNGQPRLTLNRGASRGTIKLSPRVRSSPVADAIPSIPLQSINSFLLSNRIVDKAEDFDKAPYIVAGDAERVLSGTGDRIFARGHFDPAQPVYGIFRQGKVYIDPVSKEFLGINADDIGGGEIVATEGDVATLALQRTTQEVRIGDRLFSGEERSINSTFMPSAPKTQVNGLIIDVPRGVTQIGAMDVVTLNKGQRDGLVEGNVLVVLKTGETVRDRITGQPLKIPDERAGLLMVFRTYDKLSYGLVLYASRSLAVLDKVRNP

SEQ ID NO: 3389 - protein, 341 aa, unknown
  environmental sample
MRKSLLALLLLASAGIAHGQVQLREGFPQQYTVVTGDTLWDISGKYLREPWKWPELWQANPQIENPNLIYPGDTLSLVYVNGQPRLTLNRGASRGTIKLSPRIRSSPVADAIPSIPLQAINSFLLSNRIVDTPEEFNRAPYIVAGNAERVLSGMGDRVFARGPFDAGQSAYGIFRQGKVYTDPETKEFLGINADDIGGGEVVATEDDVTTLTLQRTTQEVRLGDRLFSGEERSINSTFMPSAPKSDINGLILDVPRGVTQIGALDVVTLNKGRRDGLTEGNVLAVMKTGETVRDRITGESVKIPDERAGLLMVFRTYDKLSYGLVLYASRSLAVLDKVRNP

SEQ ID NO: 3390 - protein, 335 aa, Pseudomonas sp.
MLLLGWAAIAQAQVPLREGYPQRYTVAAGDTLWSIAGQFLRDPWQWPALWQANAQIGDPDLLYPGDVLTLVQVSGQPQLNLERGTSRGTLKLSPQVRRTPLVDAIPALPLHAIDSFLLGNRIIEREEDFQQAPYIVAGDAERVLAGSGDRVFARGHFDAGLPAAYGIFRQGKVYRDPQSQEVLGINADDIGGGEVLALDGDLATLALQRTTQEVRPGDRLFPSQAPSAAENFVPSAPDRPVDGLIIDVPRGVTQVGAMDVVTLDKGRLDGLAPGNVLAVMKTGETVRDRVAGGQVKIPDERAGLLMVFRTYDRLSYGLVLSASRSLAVQDKLRNP

SEQ ID NO: 3391 - protein, 341 aa, Pseudomonas sp.
MRKTLLALLLLVSAGVAQGQVQLRDGFPQQYTVVSGDTLWDISGKYLREPWQWPQLWRANPQIENPNLIYPGDTLTLSYVDGQPRLTVNRGESRGTIKLSPRIRTSPVAEAIPSIPLKSINAFLLSNRIVDKVEDFDKAPYIVAGDAERVLSGTGDRIYARGHFDPSQPVYGIFRQGKVYTDPQTKEFLGINADDVGGGEIVATEGDVATLALQRTTQEVRLGDRLFSGEERSINSTFMPSAPSTNINGVIIDVPRGVTQIGVMDVVTLNKGQRDGLVEGNVLAVMKTGETVRDRVTGQPLKIPDERAGLLMVFRTYEKISYGLVLNASRSLAVLDKVRNP

SEQ ID NO: 3392 - protein, 340 aa, Pseudomonas sp.
MRKSLLALLLTASGLAQAQVQLREGYPQSYTVVAGDTLWDISGKFLREPWKWREIWRANPQVHDPDLIYPGDTLALTWVDGQPRVTLNRGESRGTIKLSPRVRSTPMVEAIPSIPLGAINAFLISNRIVDNAEQFEKAPYIVAGNAERVLSGNGDRAYARGSLDPAHSVYGIFRQGKTYIDPETKEVLGINADDVGSAEVVATEGDVSTLILQRSTQEVRLGDRLFSSEERAINSTFLPSAPQAPIEGLILDVPRGVTQVSVLDVVTLNKGKRDGLAEGNVLAIYKTSETVRDRITGEQVKIPDERSGLLMVFRTYDKLSYALVLQANRSLAIMDKVRNP

SEQ ID NO: 3393 - protein, 341 aa, unknown
  environmental sample
MRKTLLALLLLTASGLAQAQVQLREGHPQRYTVVAGDTLWDISGKFLREPWRWKELWRANPSIRDPDLIYPGDTLSLTYINGEPHVQLTRGESRGTIKLSPRIRSTPTVEAIPSIPLGAINAFLISNRIVDSPEQFQQAPYIVAGNAERVLSGQGDRLYARGNLDSVNRVYGIFRQGKTYTDPVTREVLGINADDIGSGEVVATEGDVSTLVLQRTTQEVRLGDRLFASEERPVNSTFMPTPPVSNIDGLIIDVPRGVTQVAEYDVVTLDRGRRDGLEEGNVLAIYKTGEQVRDRVTGEQVKIPDERAGLLMVFRTYDKLSYALVLHATRSLAIMDKVRNP

SEQ ID NO: 3394 - protein, 341 aa, Pseudomonas sp.
MRKSLVALLLVAVGGVAQAAVQLKQGHPEQYRVVKGDTLWDISGRFLDQPWKWPELWHANPQIENPHLIYPGDTLSLVYVDGQPRLMLDRGESRGTVKLSPRIRSTPVAEAIPTIPLEAINSFLVNNRVIDSIELFEGAPYVVAGNAERVISGKGDRVYARGQFDEELPAYGIFRQGKTYLDPETGEFLGINADDIGGGDLVATEGDIATLRLNRVTQEVRLGDRLFPTEERAINSSFQPSSPATDVQGVILDVPRGVTQIGQFDVVALNRGARDGLAEGNVLAVYKTGETVRDRVTGERVKIPDERAGLLMVFRTYDKLSYGLVLQATRSLAVLDKVRNP

SEQ ID NO: 3395 - protein, 80 aa, Pseudomonas sp.
MNSALLLSNAIAIAVLVVFHFQPDGSADQSTQYRAHYVQHQAPQWAVMSSTSENPGMAQIVDAPEAVVLPANPRPESWVF

SEQ ID NO: 3396 - protein, 80 aa, Pseudomonas sp.
MNSALLLSNAIAIAVLVVFHFQPDGSADQSPQYRAHYAQHQAPQLAVMSSASENPGMAQVADAPEAVVLPANPRPESWVF

SEQ ID NO: 3397 - protein, 80 aa, Pseudomonas sp.
MNSALLLSNAIAIAVLVVFHFQPDGSADQSTQYRAHYVQHQAPQLAVMSSALENPGMARVADDPEAVVLPANPRPESWVF

SEQ ID NO: 3398 - protein, 80 aa, Pseudomonas sp.
MNSALLLSNAIAIAVLVIFHFQPDGSADQSTQYRAHSVQHQAPQWAVMSSTSENPGMTQVSDTPEAIVLPANPRPESWVF

SEQ ID NO: 3399 - protein, 359 aa, Pseudomonas sp.
MGNQVFANNMEVSCKAADGKSVACFPDVCFTPPQAPPTPTGVPIPYPNTGMAKDTTKGSRTVKITRKEVMLKNKSYFKTSYGDEAGCAPKKGVITSKIKGKVYFNSWSMDVKFEGENVVRNMDLTTHNHASQPGNSPTWPYIDTAAAANSSHPCHNVVKGLKDNNCQRHVDANTYSTDAINRAGASEALCGDPKCKKAMECVLTPYEPSNCCDGKTPHHIVPKSQFKERGKGGKALLLDAQGANKYDPNKAPCICEDGHSHSTGTHGDIHEETNLLTVNHPTVKPKVTGKTIASDARWSVAEAEAVGAEAAQKGGSKCDKECTKSQVRESHQKMNIGPTEQIRPSTAGRVPEPSNPTTF

SEQ ID NO: 3400 - protein, 361 aa, Pseudomonas sp.
MANEVYANNMEVSCKSADGKSIACFPDVCFTPPQTPATPPGVPIPYPNTGMAKDTTNGTRTVKITGKEVMLKNKSYFKTSYGDEAGCAPKKGVITSKIKGKVYFTSWSMDVKFEGENVVRNLDMTTHNHASMPGNTPLWPYIDAVAAAANPSDPCHKVTKGLADNDCQRHVKANTYSTGSVNRAGASEALCNDPKCKAAMACVLTPYSPSNCCDGKTPHHIVPKSQFKERGKGGKALLLDSNGDNKYDPDKAPCICEDGHSHSTGTHGDIHEETNLLTVTHPKVSPHVTGKTIDPNARWDVADAEAVGAKATKKGGSQCDEECTKSQVRAGHQQMGIGPNDKIRPSTAGHVPEPSNPTTFP

SEQ ID NO: 3401 - protein, 360 aa, Pseudomonas sp.
MTNEVYANNREISCKAASGKSIAAFPDVCFTPPQTPPMPLGIPIPYPNTGLSKDTTKGTRTIRITRKEVMLKNKSYYKTSYGDEPGRAPKKGIITSKIKGKVYFTSWSMDVKFEGKNVVRHMDLTTHNHGSFPGNTPTWPYLDQMAAAQNPNDPCSNVAKGLADNDCNRHIKANTSSTGSVNRKAASAALCADDKCKESMACVLTPYSPSNCCDGKTPHHIVPKSQFKELGKAGKALLLDKAGENKYDPDKAPCICEDGHSHSTGTHGDIHEETNLLTVGHPKVAPHVTGKSISPNARWDVADAEAVGAKATKKGGAQCNEECTQKQVRASHQQMGILPNDKIRPTTAGRVPEPVDTQTF

SEQ ID NO: 3402 - protein, 414 aa, Pseudomonas sp.
MTQTSPRSLLAARIGLTLALGLLATHASAAPHPQVQNDAQQYQGDALKLLERLVNIDSGSGYEAGLNQVSDIAIAELEKLGASIEKVPNGAAGGSHVLATLKGTGKARILLMAHMDTVFKEGTAAERPFRIQDGRAYGPGVMDDKGGIVAGIYALKVLDNLKFKDYAQITFLLDASEETGSEIATDLIKKTAKAHDVTLNLEPGRPADGLVVWRKGSATALVEVKGKAAHAGVAPELGRNAAMEAAHQILQLGKLGDEAKKTTINFTVLKAGDRTNVIPDQATAKADVRAAVPEEFDRIEKDLARVSANKLIADTEVKTTLQRGLPPMPQTEQSDALVAMAQGIYGELGRKLTIEGSGGAADSSLSAGVGTPTLDGFGIVGGNIHTPEEYAEVESVAPRIYLLARMIMELSAKQ

SEQ ID NO: 3403 - protein, 414 aa, Pseudomonas sp.
MTQTSPRSLLAARIGLTLALGLLATHASAAPHPQVQNDAQQYQGDALKLLERLVNIDSGSGYEAGLNQVSDIAIAELEKLGASIEKVPNGAAGGSHVLATLKGTGKARILLMAHMDTVFKEGTAAERPFRIQDGRAYGPGVMDDKGGIVAGIYALKVLDNLKFKDYAQITFLLDASEETGSEIATDLIKKTAKAHDVTLNLEPGRPADGLVVWRKGSATALVEVKGKAAHAGVAPELGRNAAMEAAHQILQLGKLGDEAKKTTINFTVLKAGDRTNVIPDQATAKADVRAAVPEEFDRIEKDLARVSANKLIADTEVKTTLQRGLPPMPQTEQSDALVAMAQGIYGELGRKLTIEGSGGAADSSLSAGVGTPTLDGFGIVGGNIHTPEEYAEVESVAPRIYLLARMIMELSTKQ

SEQ ID NO: 3404 - protein, 414 aa, Pseudomonas sp.
MTQTSPRSLLAARIGLTLALGLLATQAIAEPHPQVHNDAQQYQGDALKLLERLVNIDSGSGYEAGLNQVSDIAIAELKKLGASIEKVPNGAAGGSHVLATLKGTGKARILLMAHMDTVFKEGTAAERPFRIQDGRAYGPGVMDDKGGIVAGIYALKVLDNLKFKDYAQITFLLDASEETGSEIATDLIKKTAKAHDVTLNLEPGRPADGLVVWRKGSATALVEVKGKAAHAGVAPELGRNAAMEAAHQILQLGKLGDEAKKTTINFTVLKAGDRTNVIPDQAIAKADVRAAVPEEFDRIEKDLARVSANKLIADTEVKTTLQRGLPPMPQTEKSDALVAMAQGIYGELGRKLTIEGSGGAADSSLSAGVGTPTLDGFGIVGGNIHTPEEYAEVDSVAPRIYLLARMIMELSAKH

SEQ ID NO: 3405 - protein, 414 aa, Pseudomonas sp.
MTQTSPRSLLAARIGLTLALGLLATHASAAPHPQVQNDAQQYQGDALKLLERLVNIDSGSGYEAGLDQVSDIAIAELKKLGASIEKVPNGTAGGSHVLATLKGTGKARILLMAHMDTVFKEGTAAERPFRIQDGRAYGPGVMDDKGGIVAGIYALKVLDNLKFKDYAQITFLLDASEETGSEIATELIKKTAKAHDVTLNLEPGRPADGLVVWRKGSATALVEVKGKAAHAGVAPELGRNAAMEAAHQILQLGKLGDEEKKTTINFTVLKAGDRTNVIPDQATAKADVRAAVPEEFDRIEQDLARVSANKLIADTEVKTTLQRGLPPMPQTEKSDALVAMAQGIYGELGRKLTIEGSGGAADSSLSAGVGTPTLDGFGIVGGNIHTPEEYAEVESVAPRIYLLARMIMELSAKR

SEQ ID NO: 3406 - protein, 414 aa, Pseudomonas sp.
MTQTPPRSLLAARIGLTLALALLASQAIAAPHPQVHNDAQRYQDDALKLLERLVNIDSGSGYGAGLDQVSDIAVAELQKLGASIEKVPNGSAGGSHVLATLKGTGKARILLMAHMDTVFKEGTAAERPFRIQDGRAYGPGVMDDKGGIVAGIYALKVLDNLKFKDYAQITFLLDASEETGSQIATELIKNTAKAHDVTLNLEPGRPADGLVVWRKGSATALVEVKGKAAHAGVAPELGRNAAMEVAHQVLQLGKLGDEEKKTTINFTVLKAGDRTNVIPDQALAKADVRAAVPEEFDRIEKDLARVSANKLIADTEVKTSLQRGLPPMPRTEKSDALVAMAQGIYGELGRKLTIEGSGGAADSSLSAGVGTPTLDGFGIVGGNIHTPEEYAEVDSVAPRIYLLARMLMELSAKQ

SEQ ID NO: 3407 - protein, 414 aa, Pseudomonas sp.
MTQTSPRSLLAARIGLALALGLLAPQVIAAPHAQIHEAARHSQDDALKLLERLVNIDSGSGYGAGLDQVSDIAVAELQKLGATIEKVPNGSAGGSHVLATLKGTGKARILLMAHMDTVFKEGTAAERPFRIHDGRAYGPGVMDDKGGIVAGIYALKVLDNLKFKDYAQITFLLDASEETGSEIATELIKKTAKAHDVTLNLEPGRPADGLVVWRKGSATALVEVKGKAAHAGVAPELGRNAAMEAAHQILQLGKLGDEEKKTTINFTVLKAGDRTNVIPDLALAKADVRAAVPEEFDRIERDLARVSANKLIADTEVKTSLQRGLPPMPQTEQSAALVAMAQGIYGELGRKLTIEGSGGAADSSLSAGVGTPTLDGFGIVGGNIHTPEEYAEVDSVAPRIYLLARMIMELSAKP

SEQ ID NO: 3408 - protein, 412 aa, Pseudomonas sp.
MTFSFPRSLLAASLGLSLALSAVNAFAEPHKQVLADAEQYQPEALKLLERLVNIDSGSGYEPGLKQVSDIAIDELKKLGATIELVPNTPEKSNHVLATLKGTGKAKILLMAHMDTVFKEGSAAERPFHIKDGRAYGPGVMDDKGGIVAGIYALKVLKNLDFKDYAQITFLLDASEETGSDVATDLIKKTAKQHDVTLNLEPGRPADGLVVWRKGSATALVEVKGKAAHAGVAPELGRNAAMEAAHQILQLGKLGDEAKKTTINFTVLKAGDRTNVIPDQATAKADVRAAVPEEFDRIEKDLARVSQDKLIAETEVKTSLQRGLPPMPQTAESDRLMAMAQGIYGEIGRKLTEEGSGGAADASLSAGVGTPTLDGFGIVGGNIHTPEEYAEVASVAPRIYLLSRMIMELAKPR

SEQ ID NO: 3409 - protein, 411 aa, Pseudomonas sp.
MTFSFPRSLLAASLGLSLAFSAANAAEPHKQVLADAEQYQPEALKLLERLVNIDSGSGYEPGLKQVSDIAIDELKKLGATIELVPNTPEKSNHVLATFKGTGKAKILLMAHMDTVFKEGSAAERPFHIKDGRAYGPGVMDDKGGIVAGIYALKVLKNLDFKDYAQITFLLDASEETGSDVATDLIKKTAKQHDVTLNLEPGRPADGLVVWRKGSATALVEVKGKAAHAGVAPELGRNAAMEAAHQILQLGKLGDEAKKTTINFTVLKAGDRTNVIPDQATAKADVRAAVPEEFDRIEKDLARVSQDKLIAETEVKTSLQRGLPPMPQTAESDRLMAMAQGIYGEIGRQLTEEGSGGAADASLSAGVGTPTLDGFGIVGGNIHTPQEYAEVASVAPRIYLLSRMIMELAKPR

SEQ ID NO: 3410 - protein, 413 aa, Pseudomonas sp.
MTFKRSRSLLATSLGLTLALGAFTPAAFAEPHKQVLADAEQYKGEALKLLERLVNIDSGSGYEPGLTQVSDIAIEELKKLGATIELVPNTPDKSNHVLATLKGTGTAKILLMAHMDTVFKEGSAAARPFHIKDGRAYGPGVMDDKGGIVAGIYALKVLKNLDFKDYAQITFLLDASEETGSDVATNLIKKTAKAHDVTLNLEPGRPADGLVVWRKGSATAVVEVKGKASHAGVAPELGRNAAMEAAHQILQLGKLGDAQKKTTINFTVLNAGDRTNVIPDQATAKADVRAAVPEEFDRIEKDLARVSKDKLIPETEVTTTLKRGLPPMPQTAESDRLMAMAQGIYGEIGRKLTEEGSGGAADASLSAGVGTPTLDGFGIVGGNIHTPEEYAEVESVAPRIYLLSRMIMELTKK

SEQ ID NO: 3411 - protein, 412 aa, unknown
  environmental sample
MRAFPRSPLALRLGLALALTALAPSVIAAPHKQIQADAEQYQGEALKLLERLVNIDSGSGYAPGLNQVGDIAIEELKKLGATIELVPNTPDKSNHVLATLKGTGTKKILLMAHMDTVFKEGSAAERPFHIKDGRAYGPGVMDDKGGIVAGIYALKVLHNLNYKDYAQITVLLDASEETGSDIATDLIKKTAKAHDITLNLEPGRPADGLVVWRKGSATAVVDVKGKASHAGVAPELGRNAAMELSHQVLQLGKLGDEAMKTTINFTVLKAGDRTNVIPDQASAKADVRAAVPEEFDRIEKDLAKVSANKLIPDTEVKTSLQRGLPPMPQTAESDALVTIAQGIYGELGRTLTIEGSGGAADSSLSASVGTPTLDGFGIVGGNIHTPEEYAEVGSVAPRIYLLARMIMEAGNK

SEQ ID NO: 3412 - protein, 409 aa, Pseudomonas sp.
MLFTFPRTLLAATLAFSFALPAYSAEPHKQVQADAEQYKAEALKLLERLVNIDSGSGYEPGLTQVRDIAVDELKQLGFSIELVPDKAANNSHVIATLKGTGKAKILLMAHMDTVFKEGSAAERPFHIKDGRAYGPGVMDDKGGIVAGIYALKVLKNQGFKDYAQITLLLDASEETGSEAASELIRSTAKGHDVTLNLEPGRPADGLVVWRKGSATAVVEVKGKAAHAGVAPELGRNAAMEAAHQILQLGKLGDEDKKTTINFTVLKAGDRTNVIPDQATAKADVRAALPEEFDRIEKDLARVSANKLIPETDVKTSLQRGLPPMPQTAESDKLVAIAQGIYAELGRKLTIEGSGGAADASLSAGVGTPTLDGFGIVGGNIHTPEEYAEVESVVPRVYLLSRMIMELAKR

SEQ ID NO: 3413 - protein, 409 aa, unknown
  environmental sample
MLFNFSRTLLAATLALSFAAPAYSVEPHKPIQAQAEQYKAEALKLLERLVNIDSGSGYEPGLTQVRDIAVDELKQLGFSIELVPDKAANNSHVVATLKGTGKARILLMAHMDTVFKEGSAAERPFHIKDGRAYGPGVMDDKGGIVAGIYALKVLKGQGFKDYAQITFLLDASEETGSEAASELIRNTAKGHDVTLNLEPGRPADGLVVWRKGSATAVVEVKGKAAHAGVAPELGRNAAMEAAHQILQLGKLGDEEKKTTINFTVLKAGDRTNVIPDQATAKADVRAALPEEFDRIEKDLVRVSANKLIPETEVKTTLQRGLPPMPQTAESDKLVAIAQGIYAELGKKLTIEGSGGAADASLSAGVGTPTLDGFGIVGGNIHTADEYAEVESVVPRVYLLSRMIMELSTR

SEQ ID NO: 3414 - protein, 409 aa, Pseudomonas sp.
MRFAFPRTLLAATLALSFALPAYSAEPHKQIQADAEQYKAEALKLLERLVNIDSGSGYGPGLTQVSDIAVDELKQLGFNIERIPDAAANSSHVIATLKGTGKAKILLMAHMDTVFKEGSAAERPFHIKDGRAYGPGVMDDKGGIVAGIYALKVLKNQGFKDYERITFLLDASEETGSDIASELIRNTAKAHDVTLNLEPGRPADGLVVWRKGSATAVVEVKGKAAHAGVAPELGRNAAMEAAHQILQLGKLGDEEKKTTINFTVIKSGDRTNVIPDQATAKADVRAALPEEFDRIEKDLVRVSANKLIPETEVTTTLKRGLPPMPQTAESDKLVAIAQGIYGELGKKLTIEGSGGAADASLSAGVGTPTLDGFGIVGGNIHTADEYAEVESVAPRVYLLSRMIMELAKR

SEQ ID NO: 3415 - protein, 428 aa, Pseudomonas sp.
MVLKTSTNQTQGRNNMRSFSRSPLAAHLALALALTALAPAAMAEPHKAIQADAEQYKDEALKLLEGLVNIDSGSGYVPGLTKVSDIAIEELKKLGATIELVPNTPEASNHVVATLKGTGKAKILLMAHMDTVFKEGSAAERPFHIKDGRAYGPGVMDDKGGIVAAIYALKVLHNLKFTDYAQITVLLDASEETGSGVATELIKKTAKEHDVTLNLEPGRPADGLVVWRKGSATALVEVKGKASHAGVAPELGRNAATEVAHQILQLGKLGDGEKKTTVNFTVLKAGDRTNVIPDQASAKADVRAAVPEEFDRVEQDLARVSANKLVPDTEVKTSLVRGLPPMPQTPQSDALVAMAQDIYGELGRTLTIEGSGGAADSSLSASVGTPTLDGFGIVGGNIHTPEEYAEVGSVAPRIYLLSRMIMKLSGQP

SEQ ID NO: 3416 - protein, 422 aa, Pseudomonas sp.
MSRHPPTTIKDRFMLFNFSRTLLAATLAVSFAVPAYSAEPHKQIQAHAEQYKAEALKLLERLVNIDSGSGYEPGLTQVRDIAVDELKQLGFAIEQVPDKAANNSHVVATLKGTGKAKILLMAHMDTVFKEGSAAERPFHIKDGRAYGPGVMDDKGGIVAGIYALKVLKDQGFKDYAQITFLLDASEETGSDAASELIRNTAKAHDVTLNLEPGRPADGLVVWRKGSATAVVEVKGKAAHAGVAPELGRNAAMEVAHQILQLGKLGDEEKKTTINFTVLKAGDRTNVIPDQATAKADVRAALPEEFDRIEKDLVRVSANKLIPDTEVTTSLKRGLPPMPQTAESDKLVAIAQGIYGELGKKLTIEGSGGAADASLSAGVGTPTLDGFGIVGGNIHTPEEYAEVESVVPRVYLLSRMIMELSKR

SEQ ID NO: 3417 - protein, 417 aa, unknown
  environmental sample
MTSPFSRSLLASALAFGIAFSAAAPAFAEPNKQVQADAEQFKDDALKLLEQLVNIDTGSGYEPGLTQVRDIVVAQLKALGATIEMIPNTAPDKSQHVVATLKGSGKAKILLMAHMDTVFKEGSAAARPFHIKDGRAYGPGVMDDKGGIVAGLYALKILKKLDFKDYAQITFLLDASEETGSAAATALIQKVAKQHDVTLNLEPGRPADGLVIWRKGSATAVVEVKGKASHAGVAPELGRNAAMEVAHQILQLGKLGDAEKKTTINFTVLNAGDRTNVIPDQATAKADVRAAVPEEFDRIEKDLARVSADKLIPDTQVTTRLERGLPPMPQTPETDKLVDIAQGIYGEIGRKLTIEGSGGAADASLSAGVGVPTLDGFGIVGGNIHTPEEYAEVDSVSPRIYLLTRMIMELATHTPGK

SEQ ID NO: 3418 - protein, 417 aa, Pseudomonas sp.
MPLIFSRSALASALALAVTFGGGSLAQAATPDKLVQAGAEQAKEPALKLLEQLVNIDSGSGYEPGLSKVSAIVVEELKKLGATIETFPNTAPDKSKHVIATLKGTGKAKILLLAHMDTVFKEGSAAARPFHIKDGRAYGPGVMDDKGGIVAGIYALQILKNLNFTDYAQITFLLDASEETGSDAATDLIKKTAKQHDVTLNLEPGRPADGLVVWRKGSATAVVDVKGKASHAGVAPELGRNAAMEAAHQILQLGKLGDPEKKTTINFTTINAGDRTNVIPDQATAKADVRAAVPEEFDRIEKDLARVSADKLIPETEVSTKLIRGLPPMPQTAESDKLVAIAQGIYGELGRTLTIEGSGGAADASLAASVGVPTLDGFGIVGGNIHTPEEYAEVESVSPRIYLLTRMIMELSRGTVK

SEQ ID NO: 3419 - protein, 418 aa, Pseudomonas sp.
MPLMFSRPAHSCALALAVTLGVSALAQAAAPDTRVQSASEQYKEPALKLLEQLVNIDSGSGYEPGLTQVSAIVIDQLKKLGATIETVPNTAPDKSSHVVATFKGTGKAKILLMAHMDTVFKEGSAAARPFHIKDGRAYGPGVMDDKGGIVAGIYALQILKNINFTDYAQITFLLDASEETGSAAATELIKTTAKQHDVTLNLEPGRPADGLVVWRKGSATAEVQVKGKASHAGVAPELGRNAAMEAAHQILQLGQLGDAEKKTTINFTTINAGDRTNVIPDQAIAKADVRAAVPEEFDRIEKDLARVSADKLIPETEVSTRLIRGLPPMPQTAETDRLVSIAQGIYGELGRKLTIEGSGGAADASLAASVGVPTLDGFGIVGGNIHTPEEYAEVESVSPRIYLLTRMIMELSGAPSKQ

SEQ ID NO: 3420 - protein, 415 aa, Polaromonas sp.
MRLNFKGTMLASACSLMLALVVAVPAAHAQAMADKAVLEKAESYKGEALALLEKLVNIDSGSGYEKGLAQVRAISVDELKKLGASIETVPSGDGGAHVLATFLGTGKARILLMAHMDTVFKEGTAAAKPFYIKDGRAYGPGVMDNKGGVLAGVYAIKILQQLQFKDYAKLTFLLDNNEETGSAIATALIQKVAKQHDVTLNLEPGRPADGLVIWRKGSGTATVEVKGKTAHAGVAPELGRNAAMEAAHQILQLGKLGSPEKQTTINFTVLKAGDRTNVIPDSASAKADVRVAVPEEFDRIEKDLARVSANKLIADTEVKTTLSRGLPPMPQTAHQDALAAKAQAIYGEIGRKLTLEGSGGAADASLSAGVGVPTLDGFGIVGGNIHTENEYAEVESIVPRFYLLARMVMELSKPN

SEQ ID NO: 3421 - protein, 416 aa, Pseudomonas sp.
MTVMLRRATCSLSLAIAFAFSTASTVQAEPNHPVQSHAEQYKEEALKLLEQLVNIDSGSGYAPGLIQVGQIAADQLKQLGATIETVPNSPPDKSHHIVATLKGTGKAKILLMAHMDTVFKEGSAKERPFHIKDGRAYGPGVMDDKGGIVAGIYALKILKDLNFKDYAQITFLLDASEETGSDAATQLIQRVAREHDVTLNLEPGRPADGLVAWRKGSATATVDVTGKAAHAGVAPELGRNAAMEISHQVLQLGKLGDVEKKTTVNFTVIDAGDRTNVIPDSATAKADVRVAVPEEFDRVEQDMARVSANKLIQETDVKTHLHRGLPPMPQTAETDRLVSMAQNIYGEIGRKLTIEGSGGAADASLAAGVGVPTLDGFGIVGGNIHTPEEYAEVESVAPRLYLLARMIMELAQRDKG

SEQ ID NO: 3422 - protein, 360 aa, Pseudomonas sp.
MRSFTRSPLAAHLALALALTALAPAAMAEPHKAIQADAEQYKDEALKLLERLVNIDSGSGYVPGLTKVSDIAIEELKKLGATIELVPNTPEASNHVIATLKGTGKAKILLMAHMDTVFKEGSAAERPFHIKDGRAYGPGVMDDKGGIVAAIYALKVLHNLKFTDYAQITVLLDASEETGSGVATELIKKTAKEHDVTLNLEPGRPADGLVVWRKGSATALVEVKGKASHAGVAPELGRNAATEVAHQILQLGKLGDEEKKTTINFTVLKAGDRTNVIPDQASAKADVRAAVPEEFDRVEQDLAKVSANKLVPDTEVKTSLVRGLPPMPQTAQSDALVAMAQGIYGELGRTLTIEGSGGAA

SEQ ID NO: 3423 - protein, 371 aa, Pseudomonas sp.
MRHKEGTTMRSFSRTPLAAHLGLAFVLTALTPMVMADPHKVIQADAEQYQGEALKLLERLVNIDSGSGYVPGLTQVSDIAIEELKKLGATIELVPNTPEASNHVLATLKGTGKAKILLMAHMDTVFKEGSVAERPFHIKDGRAYGPGVMDDKGGIVAAIYALKVLHNLKFTDYAQITVLLDASEETGSVVATELIKKTAREHDVTLNLEPGRPADGLVVWRKGSATALVEVKGKASHAGVAPELGRNAATEVAHQILQLGKLGDEQKKTTINFTVLKAGDRTNVIPDQASVKADVRAAVPEEFDRIEKDLAKVSANKLVPDTEVKTSLVRGLPPMPQTAQSDALVAMAQGIYAELGRKLTIEGSGGAARFS

SEQ ID NO: 3424 - protein, 131 aa, Pseudomonas sp.
MTESRRPYGAPQPEPIDDNEDRMGSMEELDFDEEEPGARVGDPASSSVEHRTPHRHIHGSSLTGNAEDEPNDDELTPENLIREDGARSAHEAGEDRPADWDLSIVDEDDIGGGNGLDEAELAQRDPLDGKR

SEQ ID NO: 3425 - protein, 131 aa, Pseudomonas sp.
MTESRRPYGAPQPEPIDDNEDRMGSMEELDFDEEEPGARVGDPASSSVEHRTPHRHIHGSSLTGNADEEPNDDDLTPENLIREDGARSAHEAGEDQPADWDLSIVDEDDIGGGNGLGEAELAQRDPLDGKR

SEQ ID NO: 3426 - protein, 131 aa, Pseudomonas sp.
MTESRRPYGAPQPEPIDDNEDRMGSMEELDFDEEEPGARVGDPASSSVEHRTPHRHIHGSSLTGNADEEPNDDELTPENLIREDGARSAHEAGEDQPADWDLSIVDEDDIGGGNGLDEAELAHSDPLDGKP

SEQ ID NO: 3427 - protein, 131 aa, Pseudomonas sp.
MTESRRPYGAPQPEPIDDNEDRMGSVEELDFDEEEPGARVGDPASSPAEHPTPHRHIHGSSLTGNADEEPNDDELTPENLIREDGARSAHEAGEDQPADWDLSIVDEDDIGGGNGLDEAELAHSDPLDGKP

SEQ ID NO: 3428 - protein, 109 aa, Pseudomonas sp.
MGSMEELDFDEEEPGARVGDPASSSVEHRTPHRHIHGSSLTGNADEEPNDDELTPENLIREDGARSAHEAGEDQPADWDLSIVDEDDIGGGNGLDEAELAHSDPLDGKP

SEQ ID NO: 3429 - protein, 134 aa, Pseudomonas sp.
MTESRRPYGATQPEPIDDNEDRMGSMRELDFDEEEPTAEIGDEIPRREREHRMPDERVREAGLTGASTDDHEPTDDDLSPETLIREDGARDAREEGEDNPADYDLSIVDEDEIGGGTGLDEAELADIDPIDGKP

SEQ ID NO: 3430 - protein, 134 aa, Pseudomonas sp.
MTESRRPYGAPQPEPIDDNEDRMGSMEELHFDDEEPSAKIGDTIPEAELEHRLPAQRVRDAGLTGASTADHEPTDDDLSPETLIHEDGARSANEAGDGDQADWDLSIVDEDDIGGGNGLDEAELARREPLDGNR

SEQ ID NO: 3431 - protein, 711 aa, Pseudomonas sp.
MASASERSAVKKGKAATPKAAERKTTKKSAVITAAKAGQKVASRKTATPPVRVLNVRPDGLDFRDTMYIPTLVEVPVRRELSDYRKTGVPVLDQGQENACTGYGLATVAHYLLRTRRYQSDATLVSPHMLYDLARRYDEWAGEADEGSSCRGAMKGWYKHGVCPAPQWQAGNQATTLTQVLAEAAALRPLGAYFRVNHTDIVAMHAAIAEVGVLYASASVHEGWHVVGGDGHIQPSANILGGHAFAIVAYDQDGFWIQNSWGETWGYEGFAHLRYDDWLANGADAWVARLGAPVTLRVPLQASSQAKAVAAASSSETLREIRPHVISLGNDGAFDPRGDLATTAASVEEIFAVDFARITAGWAKKRIVVYAHGGLVGQAGAIETVAGYRAALLQAECYPLAFIWKTDYWSTLGNMLADAARRRRSEGVLDATKDFMLDRLDDALEPIARLLTGKAEWDEMKENGLRATVNANGGARVVAKALARLAAQGVEIHFVGHSAGSILLAPMVQYLVSRGAMNSGPMARSQLKGLEVTIASCHLWAPACTVKLFRETYLAPIRDQRIQKFGLFTLTDQAERDDHCAHIYNKSLLYLVSDAFEDKVRIPLIRPEGEPILGMERFVAGESDLAQLFASASNADWVRAPNDLPMGNPKASGARHHGDFDNDETTVRATLARILGQGGARQALVLSQPIAERAQRRRQVDLASSIGRRQP

SEQ ID NO: 3432 - protein, 711 aa, Pseudomonas sp.
MASASDRSSVKQGKAAATAQKAEKKTTIKTAATAAKAGKKVASRKTATAPVRVLNVRPDGLDFRDTMYIPTLVEVPIRRELSDYRKTRVPVLDQGQENACTGYGLATVAHYLLRTRRYQSDATLVSPHMLYDLARRYDEWAGEADEGSSCRGAMKGWYKHGVCPAPQWQANNQATTLTQVLAEEAALRPLGAYFRVNHTDIVAMHAAIAEVGVLYASATVHEGWHVVGGDGHIQPSANILGGHAFAIVAYDQDGFWIQNSWGETWGYEGFAHLRYDDWLANGADAWVARLGAPITLRVPLQASSQAKTVAAASSSETLREIRPHVISLGNDGAFDPRGDLATTAASVQEIFAVDFPRITAGWAKKRIVVYAHGGLVAQAGAIETVAGYRAAMLQAECYPLAFIWKTDYWSTLGNMLADAARRRRSEGVLDATKDFMLDRLDDALEPIARLLTGKAQWDEMKENGLRATVNANGGARVVAKALARLAAQGVEIHIVGHSAGSILLAPMVQYLVSKGTMNSGPMARSQLKGLEVKVASCHLWAPACTLKLFRETYLAPIRDKRIEKFGLFTLTDQAERDDHCAHIYNKSLLYLVSDAFEGKVRIPLIRPDGEPILGMERFVTSESDLAQLFASASNAGWVRAPNDLPMGHQNASGARHHGDFDNDETTVRATLARILGQGGARQALVLAQPIAERAQRRRQVDLASSVGRRQP

SEQ ID NO: 3433 - protein, 658 aa, Pseudomonas sp.
MNVRPDGLDFRDSMYVPTLVEVPIRRELSDYRKANVPVLDQGQENACTGYGLATVAHYLLRTRQYQSDDTAVSPHMLYDLARRYDEWAGEADEGSSCRGAMKGWYKHGVCTAPQWQVNNRNTTLTEALAQEAALRPLGAYFRVNHTDIVAMHAAIAEVGVLYASATLHAGWYGVAADGHIEPSLDLLGGHAFAIVAYDQDGFWVQNSWGEQWGDGGFAHLRYDDWLANGADAWVARLGAPITLRAPLQAAGQAKSMASASSSETLREIRPHVVSLGNDGAFDPRGDIATTAASVAEIFDVDFPRITQGWKKKRIVVYAHGGLVGQAGAIETVAGYRAAMLQAECYPLAFIWKTDYWSTLGNMLADAARRRRPEGILDATKDFMLDRLDDALEPIARLLTGKAEWDEMKENGLRATTDAAGGARVVAKALARLAAAGVEIHLVGHSAGSILLAPLVQYLVSKGTVSGGPLARSQLKGLETKIASCHLWAPACTVKLFRESYLEPIRDKRIQKFGLFTLTDQAERDDNCASIYNKSLLYLVSDAFEDRVRIPLIRPDGEPILGMEHFVESENDVAKLFGAGSNADWVRAPNNLPMGHQGASDARHHGDFDNDEATVRATLARILGSGGTRQVLALPQPVAERAQWRRRVDQASSIGRRQS

SEQ ID NO: 3434 - protein, 647 aa, Pseudomonas sp.
MYVPTLVEVPVRRELSDYRKAQVPVLDQRHENACTGYGLATVAHYLLRTRRYQFDNTDVSPHMLYELARRYDEWAGEVDEGSSCRGAMKGWYKHGVCPALKWPAGNQVTTLTEALAEEAAQRPLGAYFRVNHTDIVAMHSAIAEVGVLYASATVHDGWYAVAADGRIQPSANVLGGHAFAIVAYDQDGFWLQNSWGETWGHGGFAHLRYDDWLVNGADAWVARLGAPISLRAPLQTSAPAKVLTASSSSETLREIRPHVISLGNDGAFNPRGDLATTAASVQEIFEVDFPRITAGWGKKRIVVYAHGGLVTQAGAIETVAGYRAAMLPAECYPLAFVWKTDYWSTLGNMLADAARRRRSEGVLDATKDFMLDRLDDALEPIARLLTGKAEWDEMKENGLRATVSAAGGARVVAKALARLAAQDPSVEIHLVGHSAGSILLAPLVQYLVGKGAIDSGPLAGSQLKGLETKIASCHLWAPACTVKLFRESYLAPIRDKRIEKFGLFTLTDQAERDDHCAHIYNKSLLYLVGDAFEDRVRIPLIRPEGEPILGMARFVAGEVDLAQLFGSGSNADWVRAPNDLPMGHRNASAARHHGDFDNDEATIRATLERIRGQGAARHALALPQPVAERALRRRQVDLASSIERRQP

SEQ ID NO: 3435 - protein, 105 aa, Pseudomonas sp.
MRRLLLVSSLLLCLPAGSAMARVDAGDVATSAGVSASLYSTFKDDKMVIPARDDASSFVASGGAIRGVYLESVLQKIRQENPGLNASDEELARAILTQQAQPAGR

SEQ ID NO: 3436 - protein, 105 aa, Pseudomonas sp.
MRRLLLVSSLLLCLPAGSAMARVDAGDVATSAGVSASLYSTFKDDKRVIPARDDASSFVASGGTIRGVYLESVLQKIRQENPELNASDEDLARAILTQQTLPAGQ

SEQ ID NO: 3437 - protein, 102 aa, Pseudomonas sp.
MRRLLLVASLLLCLPAGSAMARVDAGDVATSAGVSASLYSTFKDDKRVIPARDDASSFVASGGAIRGVYLESVLQKIRRENPGLNASDEELARAILTQQAGR

SEQ ID NO: 3438 - protein, 105 aa, Pseudomonas sp.
MRRLFLVSSLVLCLPFGSAMARVDAGDVATSAGVSASLYSTFKDHKMVIPARDDASSFVASGGTIRGVYLESVLKEIRQNHPDLKASDEDLARAILVQEGVPAGQ

SEQ ID NO: 3439 - protein, 105 aa, Pseudomonas sp.
MRRLIIISSLLLCLPFGSAMAKVDAGDVATSAGVSASLYSTFKDDKRVIPARDDASSFIASGGAIRGVYLESYLKQIRQEHPGLNASDEDLARAILVQEGVAAGQ

SEQ ID NO: 3440 - protein, 105 aa, Pseudomonas sp.
MRRLIIISSLMLCLPFGSAMAKVDAEDVATSAGVSASLYSTFKDDKLMIPARDDASSFVASGGEIRGVYLESVLKKIRQDNPGLNASDEDLARAILIQEGNATGQ

SEQ ID NO: 3441 - protein, 98 aa, Pseudomonas sp.
MRRLLLISSLVLCLPVGSAMADVDAKDVATSAGVSASLYSTFKDDKIVIPARDDASSFVASGGTIRGVYLESVLKEIRQNHPDLKASDEELARAILAQ

SEQ ID NO: 3442 - protein, 105 aa, Pseudomonas sp.
MRRLIIISSLVLCLPIGSAMADVDAKDVATSAGVSASLYSTFKDDKLMIPARDDASSFVASGGAIRGVYLEQALQRVRQQNPGLNASDEDLARAILVQDGMQASQ

SEQ ID NO: 3443 - protein, 98 aa, Pseudomonas sp.
MRRLLLISSLVLCLPVGSAMADVDAKDVATSAGVSASLYSTFKDDKIVIPARDDASSFVASGGTIRGVYLESVLKEIRQNHPDLKASDEDLAKAILAQ

SEQ ID NO: 3444 - protein, 104 aa, Pseudomonas sp.
MRKLVLISSLMLCLPVGSALARVDAGDVATSAGVSASLYSTFKDDKMVIPARDDVSAFVASGGAIRGVYLESVLQQVRQANPGLNASDEDLANAILVHYEGVQQ

SEQ ID NO: 3445 - protein, 105 aa, unknown
  environmental sample
MRRLLIASSLVLCLPFGAALADVDAGDVATSAGVSASLYSTFKDDKRVIPARDDASSFIASDGAIRGVYLESMIQRVRQQNPGLQASDEDIARAILTQDELGSER

SEQ ID NO: 3446 - protein, 98 aa, Pseudomonas sp.
MRRLLLISSLVLCLPVGSAMADVEAKDVATSAGISASLYSTFKDDKIVIPARDDASSFVASGGTIRGAYLESVLKQIRQDHPDLQASDEDLAKAILAQ

SEQ ID NO: 3447 - protein, 106 aa, Pseudomonas sp.
MRRIFIISSLVLCLPFGSALAKVDAGDVATSAGVSASLYSTFKDDKLMIPARDDASSFVASGGAIRGAYLEALLKKVRQDNPALNNASDEDLARAILVREGVATDH

SEQ ID NO: 3448 - protein, 105 aa, unknown
  environmental sample
MRYSLLVPALLLCIPAGSALARVDAGDVATSAGVSASLYSTFKDDKRIIPARDELSAFVASGGAIRGAYVESALEQVRQSHPGLQASDEELAKALLSQDEVVADH

SEQ ID NO: 3449 - protein, 105 aa, unknown
  environmental sample
MRHLLLAPALLLLLPAGAALARVDAGDVATSAGVSASLYSTFKDDKRIIPARDELSAFVASGGAIRGAYVESALEQARRDHPGLQANDEELARAILSQDDRIADH

SEQ ID NO: 3450 - protein, 105 aa, unknown
  environmental sample
MRHLLLAPALLLLMPAGAALARVDAGDVATSAGVSASLYSTFKDDKRIIPARDELSAFVASGGAIRGAYVESALEQARKDHPGLQANDEELARAILSQDDPVADH

SEQ ID NO: 3451 - protein, 105 aa, Pseudomonas sp.
MRPLLLASSLLLLLPAGAALARVDAGDVATSAGISASLYSTFKDDKRIVPARDELSAFVASGGVIRGAYLESALAQARHDNPGLQISDEELAKALLSQDDAAVGQ

SEQ ID NO: 3452 - protein, 89 aa, Pseudomonas sp.
MIKNTLAAVIATATLLSAGAALADRPGAGWVSIEKAIETAKTKAGYIEIYKIEADNDGYWEGEGRKSDGVVYEFRIDGASGNVIRDQKD

SEQ ID NO: 3453 - protein, 89 aa, Pseudomonas sp.
MLKKTLAALLATASLLGAGAALADRPGAGWITIEKAIETAKTKAGYVEIYKIEADNDGYWEGEGRKSDGSVYEFRIDGASGNVLRDQKD

SEQ ID NO: 3454 - protein, 89 aa, Pseudomonas sp.
MLKKTLVALLATASLLGAGAALADRPGAGWITIEKAIETAKTKAGYVEIYKIEADNDGYWEGEGRKSDGSVYEFRIDGASGNVLRDQKD

SEQ ID NO: 3455 - protein, 89 aa, Pseudomonas sp.
MLKKTLAAVVATTALLSAGAALADKPGAGWITIEKAIETAKTKAGYVQIYKIEADNDGYWEGEGRKADGVVYEFRIDGESGNVLRDQKD

SEQ ID NO: 3456 - protein, 89 aa, Pseudomonas sp.
MIKKTLAAFVATASLLSAGAALADRPGAGWISIEKAVETAKTKAGYVEIYEIEADNDGYWEGKGRKADGIVYEFRIDGASGNVLRDQKD

SEQ ID NO: 3457 - protein, 89 aa, unknown
  environmental sample
MIKKTFAALIATAGLLSAGAALADKPGAGWITIEKAIEVAKTKAGYVEVYEIGADNDGYWEGEGRKADGTVYEFRIDGASGNVLRDQKD

SEQ ID NO: 3458 - protein, 89 aa, unknown
  environmental sample
MIKKTFAALIATAGLLSAGAALADKPGAGWITIEKAIEVAKTKAGYVEVYEIGADNDGYWEGEGRKADGIVYEFRIDGASGNVLRDQRD

SEQ ID NO: 3459 - protein, 89 aa, Pseudomonas sp.
MIKKTFAAVVATAALFSAGAAMADRPGAGWVTIEKAIEIVKTKAGYVEVYEIEADNDGYWKGEGRKADGSVYEFRIDGTSGNVLRDQKD

SEQ ID NO: 3460 - protein, 89 aa, Pseudomonas sp.
MLKNTLTAMLATATLFGAGAALADKPGAGWITIEKAIETAKTKAGYIEVYQAEADDNGYWEVKGRKADGSVYEIRIDGASGNVLRDQKD

SEQ ID NO: 3461 - protein, 99 aa, Pseudomonas sp.
MTTIHKWSEKMIKKTFAALIATASLLSAGAALADKPGAGWITIEKAIDTAKTKAGYVEIYKIEADNDGYWEGEGRKSDGVVYEFRIDGASGNILRDQKD

SEQ ID NO: 3462 - protein, 89 aa, Pseudomonas sp.
MLKKTLAALCATTALLSAGAALADKPGAGWIPIEKAIEVAKTKAGYVEVYAAEADNDGYWEVKGRKSDGVVYEARIDGASGNVLRDQKD

SEQ ID NO: 3463 - protein, 89 aa, unknown
  environmental sample
MLKKTLIALCATSALLSAGAAMADKPGAGWITIEKAIEVAKTKAGYIEVYAAEADDNGYWEVKGRKSDGTVYEARIDGASGNVLRDQKD

SEQ ID NO: 3464 - protein, 89 aa, unknown
  environmental sample
MLKKTLIALCATSALMSAGAAMADKPGAGWITIEKAIEVAKTKAGYIEVYAAEADDNGYWEVKGRKSDGIVYEARIDGASGNVLRDQKD

SEQ ID NO: 3465 - protein, 88 aa, unknown
  environmental sample
MIKKLTAAVLATAALTTAQFALADKPGAGWITIEKAIEKAKSAGYTEIYKIEADDNGYWEGEGRKADSLTYEFRIDGTSGNVLRDQKD

SEQ ID NO: 3466 - protein, 88 aa, unknown
  environmental sample
MIKKTLTALVATSALMTAGMALADRPGAGWITIEKAIETAKAKGYTEVWKIEADNDGYWEGEGRKADATVYEFRIDGTSGNFLREQKD

SEQ ID NO: 3467 - protein, 88 aa, unknown
  environmental sample
MIKKLTAAVLATAALTTAQFALADKPGAGWITIEKAIEKAKSAGYTEIYSIEADDKGYWEGEGRKADSLTYEFRIDGTSGNVLRDQKD

SEQ ID NO: 3468 - protein, 121 aa, Pseudomonas sp.
MNNLLRGLAAFALMSWASTAAFAAPQAHADSSPAPAMLLAQNLPGGSNNNPYNSPIRRANPNSMQGTQPSAPAVRGVNPVPVQRPPTLENGGIGNGYPRTITQPRIIDPTPVTPPRNQQQR

SEQ ID NO: 3469 - protein, 121 aa, Pseudomonas sp.
MNNLLRGLAAFALMSWASTAAFAAPQAHADSSPATAMLLAQNLPGSINNNPYNSPIRRANPNSMQGTQPSAPAVRGVNPVPVQRPPTLENGGIGNGYPRTITPPRIIDPTPVTPPRNQQQR

SEQ ID NO: 3470 - protein, 120 aa, Pseudomonas sp.
MNNLLRGLAVFALMSGASLPAFAAPPAHADSNPAPATLLAQNLPGSNNNPYNSPIRRANPNSMQGTQPSAPAVRGVNPVPVQRPPTLENGGIGNGYPRTITQPRIIDPTPVTPPRNQQQR

SEQ ID NO: 3471 - protein, 118 aa, Pseudomonas sp.
MNNLLRGLAVFALMSGASIAAFAAPQASSDSTAMLLAQNLPGSSNNNPYNSPIRRANPNSMQGTQPSAPAVRGVNPVPVQRPPTLENGGIGNGYPRTITQPRIIDPTPVTPPRNQQQR

SEQ ID NO: 3472 - protein, 117 aa, Pseudomonas sp.
MNNLLRGLAVFALMSGASIAAFAAPQASSDSTAMLLAQNLPGSNNNPYNSPIRRANPNSMQGTQPSAPAVRGVNPVPVQRPPTLENGGIGNGYPRTITQPRIIDPTPVTPPRNQQQR

SEQ ID NO: 3473 - protein, 107 aa, Pseudomonas sp.
MSGASAVAFAAPQAAHPDSSPTSAMLLAQNLPGSNNPYNSPIRRANPNSMQGTQPSTPAVRGVNPVPVQRPPTLENGGIGNGYPRTITQPRIIDPTPVTPPRNQQQR

SEQ ID NO: 3474 - protein, 121 aa, Pseudomonas sp.
MNHLLRTLAALALVGWAGSPAFAAPRAPLADPSPSAMLLAQNLPGSNNNPYNSPIRRANPNSMQGTQPSAPPVRGPTTVPVPRPPTLENGGIGNGYPRTGAQPPRIIDPSVKTAPRDPQQR

SEQ ID NO: 3475 - protein, 122 aa, Pseudomonas sp.
MNSLLRALLACALSSGTSIAVYAAPQAPAAESAPLAGVLLAQNLPGSNNNPYNSPIRRANPNSMQGTQPSAPPLRGPNTVPVPRPPTLENGGIGNGYPRTAPSPRTVDPTPTTTPPRNQPQR

SEQ ID NO: 3476 - protein, 644 aa, Pseudomonas sp.
MLKAGLYTLLALLSLAPGAQAGSMQWSSIRDGSLYLRAAQPDRLKIGWSPAWQSDANREQLYLLQPDGQLFKQLEIRADQAYGEQDIELPAAAGDYRLQIPGYSFRGFTVSHRGSTAAQFEPTKVHFSAEVHSGAELYFRVAAGEQAILAGKYYGGVSVLQASRLSDGAKVRLELKEHPAYGQFDQVALPPAEQDQVWRLALGGSGKAAFWLDGTANLFAQEVQQLHPLDQPRGEAHLQLKAQILGTTPHLGIALPYAQPPQSTFGLLQAIGARAANFYSFVDVIEQEPEREIGFRRLYRERFGIDRDITLLAGTGRRAVLAADAQSFAGLDAWLADSVRLAGNGLHYLAFADEPNLNYPDYSSYALYFEQMLARAKANPEARAAGVRIAMPASSRLLDGPFRVGAGQRRGIDWARKLLERHGQDIDALAWHEWMVRDLLATRRYRDSVRAAAELVGLDAAGRPRKALLLSQTNISSGRDLSPYQQDTHYAGLWWASVVINASADGLLDMLNWFQAADEPDYPKGMLAQRSASQFSLKPVAVAQQFIARHWLAHVQALDNPAFEVDALAMSEAGRHSLLGVNKASRVQAVSLDGPGDLCQAAPLKLSLLGPDDQPRDAAVECRDGRVHFELPGETLFALTWKAL

SEQ ID NO: 3477 - protein, 644 aa, Pseudomonas sp.
MLKTALYTFLALLSLAPGAHANSMQWSSIRDGSLYLRAAQPDRLKIGWSPAWQSDANREQLYLLRPDGQLFKQLEIRADQAYGEQDIELPAAAGDYRLQIPGYSFRGFTVSHRGSTAAQFEPTKVHFSAEVHSGAELYFRVAAGEQAILAGKYYGGVSVLQASRLSDGAKVRLELKEHPAYGQFDQVALPPAEQDEVWRLSLGGSGKAAFWLDGTANLFAQEVQQLHPLDQPRGEARLQLKAQILGTTPRLGIALPYAQPPQSTFGLLQAIGARAANFYSFVDVLEQEPEREIGFRRLYRERFGIDRDITLLAGTGRRAVLAADAQSFAGLDAWLADSVRLAGNGLHYLAFADEPNLNYPDYSSYALYFEQMLARAKANPEARAAGVRIAMPASSRLLDGPFRVGAGQRRGIDWARKLLERHGQDIDALAWHEWMVRDLLATRRYRDSVRAAAELVGLDAAGRPRKALLLSQTNISSGRDLSPYQQDTHYAGLWWASVVINASADGLLDMLNWFQAADEPDYPKGMLAQRSASQFSLKPVAVAQQFIARHWLAHVQALDNPAFEVDALAMSEAGRHSLLGVNKASRVQAVSLDGPGDLCQAAPLKLSLLGPDDQPRDAAVECRDGRVHFELPGETLFALTWKAL

SEQ ID NO: 3478 - protein, 644 aa, Pseudomonas sp.
MLKTAFYTFLALLSLAPGAQAESMQWSSIRDGSLYLRAAQPDRLKIGWSPAWQSDANREQLYLLQPGGQLFKQLEIRADQAYGEQDIELPAAAGDYRLQIPGYSFRGFTVSHRGSTAAQFEPTKVHFSAEVHSGAELYFRVAAGEQAILAGKYYGGVSVLQASRLSDGAKVRLELKEHPAYGQFDQVALPPAEQDEVWRLSLGGSGKAAFWLDGTANLFAQEVQQLHPLDQPRGEAHLQLKAQILGTTPRLGIALPYAQPPQSTFGLLQAIGARAANFYSFVDVIEQEPEREIGFRRLYRERFGIDRDITLLAGTGRRAVLAADAQSFAGLDAWLADSVRLAGNGLHYLAFADEPNLNYPDYSSYALYFEQMLARTKANPEARAAGVRIAMPASSRLLDGPFRVGAGQRRGIDWARKLLERHGQDIDALAWHEWMVRDLLATRRYRDSVRAAAELVGLDAAGRPRKALLLSQTNISSGRDLSPYQQDTHYAGLWWASVVINASADGLLDMLNWFQAADEPDYPKGMLAQRSANQFSLKPVAVAQQFIARHWLAHVQALDNPAFEVDALAMSEAGRHSLLGVNKASRVQAVSLDGPGDLCQAAPLKLSLLGPDDQPRDAAVECRDGRVHFELPGETLFALTWKAL

SEQ ID NO: 3479 - protein, 644 aa, Pseudomonas sp.
MLKAGFYTLLALLSLAPGAQAGSMQWSSIRDGSLYLRADQPDRLKIGWSPAWQSDANREQLYLLQPGGQLFKQLEIRADQAYGEQDIELPAATGDYRLQIPGYSFRGFRVSHRGSTAAQFEPTKVHFSAEVHSGAELFFRVAAGEQAILAGKYYGGVSVLQASRLSDGAKVRLELKEHPAYGQFDQVALPPAEQDQVWRLALGGSGKAAFWLDGTANLFAQEVQQLHPLDQPRGEARLQLKAQILGTTPRLGIALPYAQPPQSTFGLLQAIGARAANFYSFVDVIEQEPEREIGFRRLYRERFGIDRDITLLAGTGRRAVLAADAQSFAGLDAWLADSVRLAGNGLHYLAFADEPNLNYPDYSSYALYFEQMLARAKANPEARAAGVRIAMPASSRLLDGPFRVGAGQRRGIDWARQLLERHGQDIDALAWHEWMVRDLLATRRYRDSVRAAAELVGLDAAGRPRKALLLSQTNISSGRDLSPYQQDTHYAGLWWASVVINASADGLLDMLNWFQAADEPDYPKGMLAQRSANQFSLKPVAVAQQFIARHWLAHVQALDNPAFEVDALAMSEAGRHSLLGVNKASRVQAVSLDGPGDLCQAAPLKLSLLGPDDQPRDAAVECRDGRVHFELPGETLFALTWKAL

SEQ ID NO: 3480 - protein, 644 aa, Pseudomonas sp.
MLKAGFYTLLALLSLAPGAQAGSMQWSSIRDGSLYLRADQPDRLKIGWSPAWQSDANREQLYLLQPGGQLFKQLEIRADQAYGEQDIELPAATGDYRLQIPGYSFRGFRVSHRDSTAAQFEPTKLHFSAEVHSGAELFFRVAAGEQAILAGKYYGGVSVLQASRLSDGAKVRLELKEHPAYGQFDQVALPSAEQDQVWRLALGGSGKAAFWLDGTANLFAQEVQQLHPLDQPRGEAHLQLKAQILGTTPHLGIALPYAQPPQSTFGLLQAIGARAANFYSFVDVIEQEPEREIGFRRLYRERFGIDRDITLLAGTGRRAVLAADAQSFAGLDAWLADSVRLAGNGLHYLAFADEPNLNYPDYSSYALYFEQMLARAKANPEARAAGVRIAMPASSRLLDGPFRVGAGQRRGIDWARKLLERHGQDIDALAWHEWMVRDLLATRRYRDSVRAAAELVGLDAAGRPRKALLLSQTNISSGRDLSPYQQDTHYAGLWWASVVINASADGLLDMLNWFQAADEPDYPKGMLAQRSANQFSLKPVAVAQQFIARHWLAHVQALDNPAFEVDALAMSEAGRHSLLGVNKASRVQAVSLDGPGDLCQAAPLKLSLLGPDDQPRDAAVECRDGRVHFELPGETLFALTWKAL

SEQ ID NO: 3481 - protein, 644 aa, Pseudomonas sp.
MLKAGLYTLLALLSLAPGAQADSMQWSSIRDGSLYLRAAQPDRLKIGWSPAWQSDANREQLYLLQPGGQLFKQLEIRADQAYGEQDIELPAAAGDYRLQIPGYSFRGFRVSHRGSTAAQFEPAKVHFSAEVHSGAELFFRVAAGEQALLAGKYYGGVSVLQASRLSDGAKVRLELKEHPAYGQFDQLALPPAEQDEVWRLALGGSGKAAFWLDGTANLFAQEVQQLHPLDQPRGEARLRLQPRILGDTPRLGIALPYAQPPQSTFGLLQAIGARAANFYSFVDVIEQEPEREIGFRRLYRERFGIDRDITLLAGTGRRAVLASDAQSFAGLDAWLADSVRLAGNGLHYLAFADEPNLNYPDYGSYALYFEQMLARAKANPEARAAGVRIAMPASSRLLDGPLRVGAGQRRGIDWARQLLARHAQDIDALAWHEWMVRDLLATRRYRDSVRAAAELVGLDAAGRPRKALLLSQTNISSGRDLSPYQQDTHYAGLWWASVVINASADGLLDMLNWFQAADEPDYPKGMLAQRSASQFSLKPVAVAQQFIARHWLAHVQALDNPAFEVDALAMSEAGRHSLLGVNKASRVQAVSLDGPGDLCQAAPLRLSLLGPDDQPRDAAVECRDGRVHFELPGETLFALTWKAL

SEQ ID NO: 3482 - protein, 644 aa, Pseudomonas sp.
MLKAGLYTLLALLSLAPGAQAESMQWSSIRDGSLYLRAAQPDRLKIGWSPAWQSDANREQLYLLQPDGQLFKQLEIRADQAYGEQDIELPAATGDYRLQIPGYSFRGFTVSHRGSTAAQFEPTKVHFSAEVHSGAELFFRVAAGEQAILAGKYYGGVSVLQASRLSDGAKVRLELKEHPAYGQFDQVALPPAEQDEVWRLALGGSGKAAFWLDGTANLFAQEVQQLHPLDQPRGEARLQLKAQTLGTTPRLGIALPYAQPPQSTFDLLQAIGARAANFYSFVDVIKQEPEREIGFRRLYRERFGIDRDITLLAGTGRRAVLAADAQSFAGLDAWLADSVHLAGNGLHYLAFADEPNLNYPDYSSYALYFEQMLARAKANPEARAAGVRIAMPASSRLLDGPFRVGAGQHRGIDWARKLLERHGEDIDALAWHEWMVRDLLATRRYRDSVRAAAELVGLDAGGRPRKALLLSQTNISSGRDLSPYQQDTHYAGLWWASVVINASADGLLDMLNWFQAADEPDYPKGMLAQRSASQFSLKPVAVAQQFIARHWLTNVQVLDNSAFEVDALAMSEAGRHSLLGVNKASRVQAVSLDGPVGLCHASQLKLSLLGPDDQPRDAPLECRDGRVHFELPGETLFALTWKAL

SEQ ID NO: 3483 - protein, 644 aa, Pseudomonas sp.
MLKAGLYTLLTLLSLAPGAQAGSMQWSSIRDGSLYLRADQPDRLKIGWNPAWQSDANREQLYLLQPGGQLFKQLEIRADQAYGEQDIELPAATGDYRLQIPGYSFRGFAVSHRGSTAAQFEPTKVHFSAEVHSGAELYFRVAAGEQAILAGKYYGGVSVLQASRLSDGAKVRLELKEHPAYGQFDQVALPPAEQDEVWRLALGGSGKAAFWLDGTANLFAQEVQQLHPLDQPRGEARLQLKAQTLGTTPRLGIALPYAQPPQSTFDLLQAIGARAANFYSFVDVIEQEPEREIGFRRLYRERFGIDRDITLLAGTGRRAVLAADAQSFAGLDAWLADSVHLAGNGLHYLAFADEPNLNYPDYSSYALYFEQMLARAKANPEARAAGVRIAMPASSRLLDGPFRVGAGQRRGIDWARKLLAQHGEDIDALAWHEWMVRDLLATRRYRDSVRAAAELVGLDAAGRPRKALLLSQTNISSGRDLSPYQQDSHYAGLWWASVVINASADGLLDMLNWFQAADEPDYPKGMLAQRSASQFSLKPVAVAQQFIARHWLTNVQVLDNSAFEVDALAMSEAGRHSLLGVNKASRVQAVSLDGPVGLCHASQLKLSLLGPDDQPRDAPLECRDGRVHFELPGETLFALTWKAL

SEQ ID NO: 3484 - protein, 644 aa, Pseudomonas sp.
MLKTALCAALALLGLPSGARAEPMQWSSIRDGSLYLRPAQPDTLRISWSPAWQSDANREKLYLLAPDGQLARQLDIRADQAYGEQDIALAPAADDYRLQIPGYSFRGFTVSHQDSTAAQFEPTKVHFSAEVRSGAELFFKVAAGERAILAGKYYGGVSLLQASRLSDGAKVRLALEQHGDYGQFDQVALPPAERDEVWRLSLGGAGKAAFWLDGTANLFAQDARQLQPLRLPRGEVRLHLQAPLLGPTPRLGIALPYAQPPSSTFGLLQAIDARAANFYSFVDVIEQEPEREIGFRRLYRERFNIDRDITLLAGTGRRPVLAADAQSLAGLDAWLADSARLPGQGLHYLAFADEPNLNYPDYATYAAYFDRMLAQVKANPEARAAGVRIAMPASSRLLDGPFRIGAGQRRGIDWARKLLARHGDDIDALAWHEWMVRDLLATRRYRDSVRAAAELVGLDATGRPRKALLLSQTNISSGPDLSPYQQDTHYAGLWWASVAINASADGQLDMLNWFQAADEPGYPKGMLAQRSASQFSLKPVAVAQQFIARHWLATVQALDNPAFEVDALAMREAGRHSLLGVNKAARAQAVSLEGPPELCRAAPFALSLLGPDDQPRAASVECRDGRVRFELPGETLFALTWNAL

SEQ ID NO: 3485 - protein, 642 aa, Pseudomonas sp.
MKPCSLLALMLISAATALNAAPLQWGDIRDGSLYLQAEAGDTLHLRWSPAWQSDANQEQLYLLRPDGQLLQQLEIRADQPYGQREVQLPAAQGDYRLQVPGYSFRNFKISHDSATLAQFEPAKVHFSADVPSGVELYFRVAAGEQAVLAGKYYGGVSVLQATRLSDHQLLRLKLVEHPQYGQFDQIQLPVAQQDEVWRLSLGGSGKVAFWLDGTANLFAQDLRQLHPLQWTPGRVELSLKPQMRGPSPHLGIALPYAQPPQSTFELLRALGPRAANFYSFVDVIQQEPQRELGFRRLYRETFKIDRDITLLAGTGRRAVLAADSQSFAGLDAWLADSVRLGNQGLHYLAFADEPNLNYPSYTVFASYFERMLERAKANPEARAAGVRIAMPVSSRLLDGPFRIGAGQRRGIDWARQLLQAHGADIDALAWHEWMVRDLLATRRYRDSVRAAADLVGLDDLGRPRKALLLSQTNISSGPDLSPYQQDTHYAALWWMSVVANASQDGLLDMLNWFQAADEPEYPKGMLAQHDAQRFSLKPVAVAQQFIQRHWLGQVQALDNPAFEVDALALRDGPRHSLLGVTKTPRAQTIDLDGAEQICQAGPSLELLGADGHSRSAAVQCSNGRAQLQVPGETLFALTWKTL

SEQ ID NO: 3486 - protein, 642 aa, Pseudomonas sp.
MKPCSLLALMLISAATALHAAPLQWGDIRDGSLYLQAEAGDTLHLRWSPAWQSDANQEQLYLLRPDGQLLQQLEIRADQPYGQREVQLPAAQGDYRLQVPGYSFRNFKVSHDSATLAQFEPAKVHFSADVPSGVELYFRVAAGEQAVLAGKYYGGVSVLQATRLSDHQLLRLKLVEHPQYGQFDQIQLPVAQQDEVWRLSLGGSGKVAFWLDGTANLFAQDLRQLHPLQWTPGRVELNLKPQMRGPSPHLGIALPYAQPPQSTFELLRALGPRAANFYSFVDVIQQEPQRELGFRRLYRETFKIDRDITLLAGTGRRAVLAADSQSFAGLDAWLADSVRLGNQGLHYLAFADEPNLNYPSYAVFASYFGRMLEHVKANPEARAAGVRIAMPVSSRLLDGPFRIGAGQRRGIDWARQLLEAHGADIDAMAWHEWMVRDLLATRRYRASVRAAADLVGLDDLGRPRKALLLSQTNISSGPDLSPYQQDTHYAALWWMSVVANASQDGLLDMLNWFQAADEPEYPKGMLAQHDAQRFSLKPVAVAQQFIQRHWLGQVQALDNPAFEVDALALRDGSRHSLLGVTKTPRAQTVDLDGAEQICQAGPSLELLGADGHSRSAAVQCSNGRAQLQVPGETLFALTWKTL

SEQ ID NO: 3487 - protein, 642 aa, Pseudomonas sp.
MKPCSLLALMLISAATALHAAPLQWGDIRDGSLYLQAEAGDTLHLRWSPAWQSDANQEQLYLLRPDGQLLQQLEIRADQPYGQREVQLPAAQGDYRLQVPGYSFRNFKVSHDSATRAQFEPAKVHFSADVPSGVELYFRVAAGEQAVLAGKYYGGVSVLQATRLSDHQLLRLKLVEHPQYGQFDQIQLPVAQQDEVWRLSLGGSGKVAFWLDGTANLFAQDLRQLHPLQWTPGRVELSLKPQMRGPSPHLGIALPYAQPPQSTFELLRALGPRAANFYSFVDVIQQEPQRELGFRRLYRETFKIDRDITLLAGTGRRAVLAADSQSFAGLDAWLADSVRLGNQGLHYLAFADEPNLNYPSYAVFASYFGRMLEHVKANPEARAAGVRIAMPVSSRLLDGPFRIGAGQRRGIDWARQLLEAHGADIDAMAWHEWMVRDLLATRRYRASVRAAADLVGLDDLGRPRKALLLSQTNISSGPDLSPYQQDTHYAALWWMSVVANASQDGLLDMLNWFQAADEPEYPKGMLAQHDAQRFSLKPVAVAQQFIQRHWLGQVQALDNPAFEVDALALRDGPRHSLLGVTKTPRAQTIDLDGAEQICQAGPSLELLGADGHSRSAAVQCSNGRAQLQVPGETLFALTWKTL

SEQ ID NO: 3488 - protein, 642 aa, Pseudomonas sp.
MKPCSLLALTWLWAASSLHAAPMQWGDIRDGSLYLQADTADTLQLRWSPAWQSDANQEQLYLLAPDGQLLQQLEIRADQPYGQRDVPLPAAQGDYRLQVPGYSFRNFKVFHDSATRAQFEPAKVHFSADVPSGVELYFRVAAGEQAVLAGKYYGGVSVLQAVRLSDGQRVRLQLEEHPQYGEFDQVALPEAPQDEIWRLSLGGSGKVGFWLDGSANLFAQDLRQLHPLQWTPAQVELSLKPQVRGPSPQLGIALPYAEPPPSTFELLRALGPRAANFYSFVDVIKAEPERELSFRKLYRETFGIDRDITLLAGTGRRAVLDADSTSFAGLDAWLADSVRLGNQGLHYLAFADEPNLNYPSYGAFASYFTRMLEHTKANPEARAAGVRIAMPASSRLLDGPFRIGAGQRRGIDWARQLLAEHGHDIDALAWHEWMVRDLLATRRYRNSVRAAADLVGLDEQGRPRKALLLSQTNISSGPDLSPYQQDTHYAALWWASVVINASQDGLLDMLNWFQAADEPEYPKGMLAQRNGQSFSLKPVAVAQQFIQQHWLAQVQALDNPAFEVDALALQDGRRHSLLGVAKTPRAQTIALSGALQICQSGPSLALLGPDGRRRSAEVQCSDGRAVFQLPGETLFALTWKTL

SEQ ID NO: 3489 - protein, 642 aa, Pseudomonas sp.
MKPCSLLALMLISATTALHAAPLQWGDIRDGSLYLQADAGDTLHLRWSPAWQSDANQEQLYLLRPDGQLLQQLEIRADQPYGQREVQLPAAQGDYRLQVPGYSFRNFKVSHDSATRAQFEPAKVHFSADVPSGVELYFRVAAGEQAVLAGKYYGGVSVLQATRLSDHQLLRLKLVEHPQYGQFDQIPLPVAQQDEVWRLSLGGSGKVAFWLDGTANLFAQDLRQLHPLQWTPGRVELSLKPQMRGPSPHLGIALPYAQPPQSTFELLRALGPRAANFYSFVDVIQQEPQRELGFRRLYRETFKIDRDITLLAGTGRRAVLAADSQSFAGLDAWLADSVRLGNLGLHYLAFADEPNLNYPSYAVFASYFGRMLEHVKANPEARAAGVRIAMPVSSRLLDGPFRIGAGQRRGIDWARQLLEAHGADIDAMAWHEWMVRDLLATRRYRASVRAAADLVGLDDLGRPRKALLLSQTNISSGPDLSPYQQDTHYAALWWMSVVANASQDGLLDMLNWFQAADEPEYPKGMLAQHDAQRFSLKPVAVAQQFIQRHWLGQVQALDNPAFEVDALALRDGPRHSLLGVTKTPRAQTIDLDGAEQICQAGPSLELLGADGHSRSAAVQCSNGRAQLQVPGETLFALTWKTL

SEQ ID NO: 3490 - protein, 642 aa, Pseudomonas sp.
MKPCSLLALMLISAATALHAAPLQWGDIRDGSLYLQAEAGDTLHLRWSPAWQSDANQEQLYLLRPDGQLLQQLEIRADQPYGQREVQLPAAQGDYRLQVPGYSFRNFKVSHDSATRAQFEPAKVHFSADVPSGVELYFRVAAGEQAVLAGKYYGGVSVLQATRLSDHQLLRLKLVEHPQYGQFDQIPLPVAQQDEVWRLSLGGSGKVAFWLDGTANLFAQDLRQLHPLQWTPGRVELSLKPQMRGPSPHLGIALPYAQPPQSTFELLRALGPRAANFYSFVDVIQQEPQRELGFRRLYRETFKIDRDITLLAGTGRRAVLAADSQSFAGLDAWLADSVRLGNQGLHYLAFADEPNLNYPSYAVFASYFGRMLEHVKANPDARAAGVRIAMPVSSRLLDGPFRIGAGQRRGIDWARQLLEAHGADIDAMAWHEWMVRDLLATRRYRASVRAAADLVGLDDLGRPRKALLLSQTNISSGPDLSPYQQDTHYAALWWMSVVANASQDGLLDMLNWFQAADEPEYPKGMLAQHDAQRFSLKPVAVAQQFIQQHWLGQVQALDNPAFEVDALALRDGPRHSLLGVTKTPRAQTIDLDGAEQICQAGPSLELLGADGHSRSAAVQCSNGRAQLQVPGETLFALTWKTL

SEQ ID NO: 3491 - protein, 642 aa, Pseudomonas sp.
MKPRYLFALLLITAIPSLHAAPMQWADIRDGSLYLQVDTPDTLQLRWSPAWQSDANQEQLYLLQPDGQLLQQLDIRADQPYGQREIQLPAARGDYRLQVPGYSFRNFKVSHDSSTLAQFEPAKVHFSADVPSGVELYFRVAAGEQAQLAGKYYGGVSVLQATRLSDGEQRRLALVEHPQYGQFDRIALPVAGQDEIWRLSLGGSGKVAFWLDGSANLFAQDLRQLHPLQWTPSRVELTLKPQGRGPSPQLGIALPYAEPPPSTFDLLRALGPRAANFYSFVDVIRQEPGRELSFRRLYRETFSIERDITLLAGTGRRAVLEADSSSFAGLDAWLADSVQLGNQGLHYLAFADEPNLNYPNYGVFADYFARMLEHTKANPEARAAGVRIAMPVSSRLLDGPFRVGAGQRRGIDWARQLLAEHAPDIDALAWHEWMIRDLLATRRYRASVRAAADLVGLDQQGRPRKALLLSQTNISSGPDLSPYQQDTHYAALWWTSVVINASQDGLLDMLNWFQAADEPEYPKGMLAQQDAQRFSLKPVAVAQQFIQQHWLGEVQSLDNPAFEVDALALRDGPRHSLLGVAKTPREQTIDLGGAPQLCESAPSLQLLGADGRARAGQLQCSQGRASFQLPGEALFALTWNTL

SEQ ID NO: 3492 - protein, 432 aa, Pseudomonas sp.
MDMRKGALISGDSASYSDLNRLNQLKVGDKNSEGNLRKVAQEFESLFLGEMLKSMRSATEALGKDNPMNTPEAKQYQEMYDQQLAVSMSREGGGIGLADVLLRQMSKNKPLASGEAATLSAAKQQEALDKAKAPVPTPVAAGTLPDGPLSRSNGQRPLWASRAVSAPQGAEGIHRNDMELINQRRLALPPKLADRLLAGLVPSASVKPEAVAQNVLPDRAVAAVKPATGELANGDWLAALKAVEPKGDMQVYGRAVAQPPLAPARKAFRDADEFVNAMLPMAKEAADRIGVDPRYLVAQAALETGWGKSVMRQPDGSSSHNLFGIKASKNWTGDSARAITSEFRNGEMVKETAEFRSYASYRDSFHDLVNLLQSNSRYQDVLKSADNPEQFVRELQKAGYATDPNYANKISNIARQMTSYQNYASAGATTTL

SEQ ID NO: 3493 - protein, 435 aa, Pseudomonas sp.
MVDMRKGALISGDSGSYSDLNRLNQLKVGDKNSEGNLRKVAQEFESLFLGEMLKSMRSATEALGKDNPMNTPEAKQYQEMYDQQLAVSMSREGGGIGLADVLLRQMSKNKPLASGEAATLSAAKQQEAQDKVAKAPVPTPVAAGTLPTDGPLSRTNGQRPLWASRAVSAPQGAEGVHRNDMELLNQRRLALPPKLADRLLAGLVPSASANADVPAQNLLPDRAIAAVKPATGELANGDWLAALKASEPKGDMQVYGRAVAQPPLAPARKAFRDADEFVNAMLPMAKEAADRIGVDPRYLVAQAALETGWGKSVMRQPDGNSSHNLFGIKASANWKGDSARAITSEFRNGAMVKETAEFRSYASYRDSFHDLVNLLQSNSRYQDVLKSADNPEQFVRELQKAGYATDPNYASKISNIARQMTSYQNYASAGATTTL

SEQ ID NO: 3494 - protein, 434 aa, unknown
  environmental sample
MDMRKGALISGDSGSYSDLNRLNQLKVGDKNSDGNLRKVAQEFESLFLGEMLKSMRSATEALGKDNPMNTPEAKQYQEMYDQQLAVSMSREGGGIGLADVLLRQMSKNKPLAPGEAATLSAAKQQEALDKVAKAPVPTPVAAGTLPTDGPLSRTSGQRPLWASRAVSAPQGAEGVHRNDMELLNQRRLALPPKLADRLLAGLVPSASANTDVPAQNLLPDRTIAAVKPATGELANGDWLAALKAAEPKGDMQVYGRAVAQPPLAPARKAFRDADEFVNAMLPMAKEAADRIGVDPRYLVAQAALETGWGKSVMRQPDGSSSHNLFGIKASANWKGDSARAITSEFRNGAMVKETAEFRSYASYRDSFHDLVNLLQSNSRYQDVLKSADNPEQFVRELQKAGYATDPHYASKISNIARQMTSYQNYASAGATTTL

SEQ ID NO: 3495 - protein, 434 aa, Pseudomonas sp.
MDMRKGTLISGDSGSYSDLNRLNQLKVGDKNSDGNLRKVAQEFESLFLGEMLKSMRSATDALGKDNPMNTPEAKQYQEMYDQQLAVSMSREGGGIGLADVLLRQMSKNKPLAPGEAASLSAAKQQEALDKVAKAAVPTPVAAGTLPDGPLSRSNGQRPLWASRAVNVPQGAGEGTHRNDMELINQRRLALPPKLADRLLAGLVPSAAANADVPAQNVLTDRAIAAVKPATGELANGDWLAALKAAEPKGDMQVYGRAVAQPPLAPARKAFRDADEFVNAMLPMAKEAADRIGVDPRYLVAQAALETGWGKSVMRQPDGSSSHNLFGIKASANWKGDSARAITSEFRNGAMVKETAEFRSYASYRDSFHDLVNLLQSNSRYQDVLKSADNPEQFVRELQKAGYATDPHYASKISNIARQMTRYQNYASAGATTTL

SEQ ID NO: 3496 - protein, 434 aa, Pseudomonas sp.
MDMRKGTLISGDSGSYSDLNRLNQLKVGDKNSDGNLRKVAQEFESLFLGEMLKSMRSATDALGKDNPLNTPEAKQYQEMYDQQLAVSMSREGGGIGLADVLLRQMSKNKPLAPGEAASLSAAKQQEALDKVAKVAVPTPVAAGTLPDGPLSRSNGQRPLWASRAVNAPQGAGEGTHRNDMELINQRRLALPPKLADRLLAGLVPSASVNAEAPAQNVLTDRAIAAAKPATGELANGDWLAALKASEPSGGMQVYGRSVAQPPLAPARKAFRDADEFVNAMLPMAKEAADRIGVDPRYLVAQAALETGWGKSVMRQPDGTSSHNLFGIKASQSWKGDSARAITSEFRNGEMVKETAEFRSYASYRDSFHDLVNLLQSNSRYQDVLKSADNPEQFVRELQKAGYATDPHYASKISNIARQMTSYQNYASAGATTTL

SEQ ID NO: 3497 - protein, 434 aa, Pseudomonas sp.
MDMRKGALISGDSGSYSDLNRLNQLKVGDKNSDGNLRKVAQEFESLFIGEMLKSMRAATESMGKDNPLNTAEAKQYQEMYDQQLAVSMSREGGGIGLADVLLRQMSKNKPLVSGEAATLSAGKQEQALDEAVKAPVPTPIAAGTLPDGPLSRSNGQRPLWASRAVSAPQGAGEGVHRNDMELLNQRRLALPPKLADRLLAGLVPSAAAAPDVKAQNILPDRAITAVKPATGELANGDWLAALKASEPSESMQVYGRAVAQPPLAPARKAFRDADEFVDAMLPMAKEAADRIGVDPRYLVAQAALETGWGKSVMRQPDGSSSHNLFGIKASKNWTGDSARAITSEFRNGEMVKETAQFRSYASYRDSFHDLVNLLQSNSRYQDVLKSADNPEQFVRELQKAGYATDPNYASKISNIARQMTSYQNYASAGATTTL

SEQ ID NO: 3498 - protein, 435 aa, Pseudomonas sp.
MDMRKGALISGDSGSYSDLNRLNQLKVGDKNSDGNLRKVAQEFESLFLGEMLKSMRSATEALGKDNPMNTPEAKQYQEMYDQQLAVSMSREGGGIGLADVLLRQMSKNKPLAPGEAAAASAAKQQEALDKVKAVPTPVAAGTLPTNGPLSRLSGQRPLWASRAVSAPQGAGEGSHRNDMELLNQRRLALPPKLADRLLAGLVPSASTNADINAPVQNIRSDRAVSATQSTSGEMANGDWLAALKASGSSGDMQVYGRAVAQPPLAPARKAFRDADEFVNAMLPMAKEAAARIGIDPRYLVAQAALETGWGKSVMRQPDGSSSHNLFGIKASQNWKGDSARAITSEFRNGEMVKETAEFRSYASYRDSFHDLVNLLQSNSRYQAVLKSADNPEQFVRELQKAGYATDPHYASKISHIARQMTSSQNYASAGATTTL

SEQ ID NO: 3499 - protein, 429 aa, Pseudomonas sp.
MDMRKGMGVSGNDSGSYSDLNRLNQLKVGDKNSDGNMRKVAQEFESLFIGEMLKSMRSATDTLGQDNPLNTEAAKQYQEMYDQQLAVSMSREGGGIGLADVLMRQMSKNKPLAPGEAATLSAAKQEAAKAAAHTPIAAGTVGTDGPLSRINGQRPLWASRAVNAPQAAGEGGHRNDMELINQRRLALPPKLADRLLAGLVPSATVNAASVNKAPLPESTAAATGTGALYNGDWLANAQAAANPGLQIHGRAIAQIPLAPAKKAFTSSDEFVNTMLPMAKEAAERIGVDPRYLVAQAALETGWGKSVMRAQDGSSSHNLFGIKASSNWKGDSARAITSEFRNGAMVKETAQFRSYDSYKDSFHDLVTLLQSNDRYQDVLKSADNPEQFVRELQKAGYATDPNYANKISQIAKQMTSYQNYAAAGASTTPL

SEQ ID NO: 3500 - protein, 431 aa, Pseudomonas sp.
MDMRKSGLVSSSDSGSYSDLNRLNQLKVGDKNSDGNMRKVAQEFESLFLGEMLKSMRSATEALGKDNPLNTPAAKQYQEMYDQQLAISMSREGGGIGLADVLMRQMSKNKPLAPGEAAAASAAKQEAAKAAVPTPIAAGTVATDGPLSRLNGQRPLWASRSVKAPAGEGTHRNDMELINQRRLALPPKLADRLLAGLVPSATTAATANKPLLPERGVATPAAATGAGPLFNGDWLASQTDTKSSGRLQVYGRAMAQIPLAPPKKAFSSADEFVNTMLPMAKEAAERIGVDPRYLVAQAALETGWGKSVMRAQDGSSSHNLFGIKAGTSWKGDSARAITSEFRNGEMVKETAEFRSYDSYKDSFHDLVTLLQTNNRYQDVVKSADNPEQFVRELQKAGYATDPDYASKISQIAKQMTSYQNYAAAGASTTPL

SEQ ID NO: 3501 - protein, 427 aa, Pseudomonas sp.
MDMFKSGRVSSSDSGAFSDLNRLNQLKVGDKNSDANMRKVAQEFESLFLGEMLKSMRSATEALGKDNPLNTAEAKQYQEMYDQQLAVSMSREGGGIGLADVLMRQMSKNKPLAPGEAATLSAAKQEAAKAAAQTPIAAGTVAINGPLSRVNGERPLWASRSVKAPTGEGTHSNDMALINQRRLALPPKLADRLLAGLVPSATSTATAAVNKTALPERTTITGAGPLYNGDWLANAQAASNGGLQIHGRAIAQIPLAPAKKAFSSADQFVNTMLPMAKEAADRIGVDPRYLVAQAALETGWGKSVMRAQDGSSSHNLFGIKASSNWKGDSARAITSEFRNGEMVKETAEFRSYASFKDSFHDLVTLLQTNNRYQDVLKSADNPEQFVRELQKAGYATDPDYASKISQIAKQMTSYQNYAAAGVSTTPL

SEQ ID NO: 3502 - protein, 432 aa, Pseudomonas sp.
MDMRKGGLGVSSSDSGSYSDLNRLNQLKVGDKNSDGNMRKVAQEFESLFLGEMLKSMRSATETLGQDNPLNTPAAKQYQEMYDQQLAVSMSREGGGIGLADVLMRQMSKNKPMAPGEAAAASAAKQAAAKAAVETPIAAGTVATNGPLSRLNGERPLWASRSVKSASAGEGTHRNDMALINQRRLALPPKLADRLLAGLVPSASTTAATAATAQNNIQMPQNTKTGAGPLYNGDWLASQTDATSSGRLQVYGRAMAQIPLAPAKKAFSSADEFVNTMLPMAKEAAERIGVDPRYLVAQAALETGWGKSVMRAQDGSSSHNLFGIKAGSSWKGDSARAITSEFRNGEMVKETAQFRSYDSYKDSFHDLVTLLQTNNRYQDVVKSADNPEQFVRELQKAGYATDPDYASKISQIAKQMTSYQNYAAAGATTTPL

SEQ ID NO: 3503 - protein, 428 aa, Pseudomonas sp.
MDMRKSGLVSSSDSGSYSDLNRLNQLKVGDKNSDGNMRKVAQEFESLFLNEMLKSMRSATEALGQDNPLNTAAAKQYQEMYDQQLAVSMSREGGGIGLADVLMRQMSKNKPLAPGEAAELSAAKQEAAKAAVQTPIAAGTTATDGPLSRLNGQRPLWASRSVHAPQGAGEGGGHSNDMALINQRRLALPPKLADRLLAGLVPSASGAAASNANTTLPARATTEGNALVKGDWLPAQSYSAERGRLQVYGRAIAQPPLAPAKKSFSSPSEFIDTMLPMAKQAADRIGVDPRYLVAQAALETGYGKSVMRQADGNSSHNLFGIKTGSTWKGAQARAITSEFRNGAMVKETAEFRSYASYQDSFHDLVTLLQSNNRYQEVLKSADNPEQFVRELQKAGYATDPNYASKISQIAKQMKSYENYAAASSPMHL

SEQ ID NO: 3504 - protein, 428 aa, Pseudomonas sp.
MDMRKGSLVGTGDSGSYSDLNRLNQLKVGDKNSDANMRKVAQEFESLFLGEMLKSMRSATEALGKDNPMNTPAAKQYQEMYDQQLAVSLSREGGGIGLADVLMKQMSKNRPLAPGEAAAASAAKQEAAKAAAVQTPIAAGTTATNGPLSRLNGERPLWASRSGHVSNTEASHSNDMAMINKRRLALPPKLADRLLAGLVPSATPTTANALPQRAATTATTGAGPLYNGDWLTRAEDAKASGGQMQIYGRAMAQIPLAPAKRAFSSADEFVNTMLPMAKEAAARIGVDPRYLVAQAALETGWGKSVMRAQDGSSSHNLFGIKASSNWTGDSARAITSEFRNGQMVKETAEFRSYASYKDSFHDLVTLLQTNNRYQDVVKSADNPEQFVRELQKAGYATDPNYATKISQIAKQMNSFENYAAAGVSTQPL

SEQ ID NO: 3505 - protein, 420 aa, Erwinia sp.
MDIRKSGLVSSGDSGSYSDLNRLNQLKVGDKNSDANMRKVAQEFESLFLNEMLKSMRSATEALGKDNPLNTPAAKQYQEMYDQQLAVSMSREGGGIGLADVLMRQMSKNKSTNPAAAATLPGAQVDKVVTPTAIAAGTTALGGPLSRVNGQRPLWASRALEPQRAEGSGTHNDMALLNQRRISLPSKLTDRLLAGIVPSADSAATNRTALPERTTAATDALVKNSSRSFAAVPHARMQIYGRAVAQPPLAPAKKAFSSADEFVATMLPMAQQAADRIGVDPRYLVAQAALETGWGKSVMRQQDGSSSHNLFGIKAGSSWKGDQARAITSEFRNGQMVKETAEFRSYASYQDSFHDLVTLLQSNNRYQEVLKAADNPEQFVRELQKAGYATDPDYASKISQIAKQMKSYENYAAAGASTNL

SEQ ID NO: 3506 - protein, 422 aa, Pseudomonas sp.
MAMDMRNSGLTSTADSGSYSDLNRLNQLKVGDKNSEGNMRKVAQEFESLFLSEMLKSMRSATEALGKDNPMNTPAAKQYQEMYDQQLAVSMSREGGGIGLADVLMRQMQKNKPVDAQAATLQGPAAAEAVKKVDVPTQIAAGTQAEGPLGRSNGQRPLWAYRVAEPQAGAAAAHSNDIALMNQRRIALPSKLTDRLLAGIVPSTDTTTVAQAAPLRNSAAADNVVNSTARTFAVPSGRMQVYGRAVAQPPLAPVKKAFSSQDEFVATMLPMAKAAAARIGVDPKYLVAQAALETGWGKSVMRAEDGSSSHNLFGIKAGQSWQGGQARAITSEFRDGAMVKETAQFRSYASYQDSFHDLVTLLQSNDRYKEVVKSADNPEQFVRELQKAGYATDPAYASKISQIAKTMNSYQNYAAAGATTHL

SEQ ID NO: 3507 - protein, 421 aa, Pseudomonas sp.
MDMHKSGFTSTADSGSYSDLNRLNQLKVGADKNSEGNMRKVAQEFESLFLSEMLKSMRSATEALGKDNPLNTPAAKQYQEMYDQQLAVSMSREGGGIGLADVLMRQMQKNKPVEAQSSTLQGPAAAEPVKAKKVDVPTEIGAGTLANGPLGRSNGQRPLWAYRVAEPQGASAHTNDMELMNQRRMALPSKLTDRLLAGIVPSTQPATQAASAPLRNSAATDNVVNSTARNFAVPSGRMQVYGRAIAQPPLAPAKKAFSSQDEFVATMLPMAKAAAARIGVDPKYLVAQAALETGWGKSVMRAEDGSSSHNLFGIKAGQSWQGGQARAITSEFRDGSMVKETAQFRSYNSYQDSFHDLVTLLQSNDRYKEVVKSADNPEQFVRELQKAGYATDPDYASKISQIAKTMNSYQNFAAAGATTHL

SEQ ID NO: 3508 - protein, 420 aa, Pseudomonas sp.
MDMRKSGISSTADSGSYSDLNRLNQLKVGDKNSDGNMRKVAQEFESLFLSEMLKSMRKATDAVGEDNPLNTDAAKQYQDMYDQQLAVSMSREGGGIGLADVLMRQMQKNKPLDAQAATLQGPGAVEPAKKVDVPTEIAAGTQASGPLGRSNGQRPLWAYRVAEPQVGGAASHSNDVALMNQRRIALPSKLTDRLLAGIVPTAPVAIDAKSAPLRNSAAADNVVNSSARAFAAPSGQMQVYARAVAQPPLAPAKKAFSSQDEFVATMLPMAKAAAARIGIDPKYLVAQAALETGWGKSVMRAQDGSSSHNLFGIKAGKSWQGEQARAITSEFRDGAMVKETAQFRSYTSYQDSFHDLVTLLQSNDRYKDVVKSADNPEQFVRELQKAGYATDPDYASKISQIAKTMGSYQNYAAAGATTHL

SEQ ID NO: 3509 - protein, 218 aa, Pseudomonas sp.
MIDVTVWSVTLPVQTPAQVVATKAMPTLKNKYFDNNGQRIIFWAPVTGSHTGNSKYPRSELRETSRDGKHRNWRYNSGTNTLKGELSVNQVPSEGRVVVAQIHAKDAPTPLLKLVYRYEKGTGNIDVEYRVKPKDKKSPVIYTVPKVPLNKSFSYTLQMDKQGQLSVLIGKSGKQVKLDKSWQGYNFYFKAGVYTLDNKGYSNEGGKVTYTKLSVSHK

SEQ ID NO: 3510 - protein, 218 aa, Pseudomonas sp.
MIDVTVWSVTLPVQTPAQVVATKAMPTLKNKYFDNNGQRIIFWAPVTGSHTGNSKYPRSELRETSRDGKHRNWRYNSGTNTLKGELSVNQVPSEGRVVVAQIHAKDAPTPLLKLVYRYAKGTGNIDVEYRVKPKDKKSPVIYTVPKVPLNKSFSYTLQMDKQGQLSVLIGKGGKQVKLDKSWYGYNFYFKAGVYTLDNKGYSNEGGKVTYTKLSVSHK

SEQ ID NO: 3511 - protein, 218 aa, Pseudomonas sp.
MIDVTVWSVTLPVQTPAQVVATKAMPTLKNKYFDNNGQRIVFWAPVTGSHTGNSKYPRSELRETSRDGKHRNWRYNSGTNTLKGELSVNQVPSEGRVVVAQIHAKEAPTPLLKLVYRYEKGIGNIDVEYRVKPKDKKSPVIFTVPKVPLNKSFSYTLQMDKQGQLSVLIGKSGKQVKLDKSWQGYDFYFKAGVYTLDNKGYSNEGGKVTYTKLSVSHK

SEQ ID NO: 3512 - protein, 218 aa, Pseudomonas sp.
MIDVTVWSVTLPVQTPAQVVATKAMPSLKNKYFDNNGQRIVFWAPVTGSHTGNSKFPRSELRETSKDGKHRNWRYNSGTNTLKGELSVNQVPSEGRVVVAQIHAKNAPTPLLKLVYRYEKGTGNIDVEYRVKPNDKKSPVIYTVPKVPLNKSFSYTLQMDKQGQLTMLIGSSGKQVKLDKSWYGYDFYFKAGVYTLDNKGYSNEGGKVTYTKLSASHK

SEQ ID NO: 3513 - protein, 218 aa, Pseudomonas sp.
MIDLTVWNITLPVQTPAQVVATKAMPTLKNKYFDNNGQRIVFWAPVTGSHTGKSEYPRSELRETGKDGKLRNWRYNSGTNTLKGELSVNQVPSEGRVVVAQIHAKDAPTPLLKLVYRYEKGTGNIDVEYRVKPKDKKSPVIYTVPKVPLNKSFSYTLQMDKQGQLSVLIGNSGKQVKLDKSWQGYDFYFKAGVYTLDNKGYSNEGGKVTYTKLDVSHK

SEQ ID NO: 3514 - protein, 218 aa, Pseudomonas sp.
MIDLTVWNITLPVQTPAQVVATKAMPTLKNKYFDNNGQRIVFWAPVTGSHTGKSEYPRSELRETGKDGKLRNWRYNSGTNTLKGELSVNQVPSEGRVVVAQIHAKDAPTPLLKLVYRYEKGTGNIDVEYRIKPKDKKSPVIYTVPKVPLNKSFSYTLQMDKQGQLSVLIGNSGKQVKLDKSWQGYDFYFKAGVYTLDNKGYSNEGGKVTYTKLDVSHK

SEQ ID NO: 3515 - protein, 218 aa, unknown
  environmental sample
MIDLTVWNITLPVQTPAQVVATKAMPALKNKYFDNNGQRIVFWAPVTGSHTGKSEYPRSELRETSKDGKLRNWRYNSGINTLKGTLAVNQVPSEGRVVVAQIHAKDAPTPLLKLVYRYAKGTGNIDVEYRVKPKDKKSPAIYTVPNVPLNKAFSYSLQMDKQGKLSVLINNVGKQVKLDSSWYGYDFYFKAGVYTLDNKGYSNEGGKVTYTRLDVSHK

SEQ ID NO: 3516 - protein, 218 aa, Pseudomonas sp.
MIDLTVWNITLPVQTPAQVVATKAMPTLQNKYFNRSGERIVFWAPVTGSHTGKSDYPRSELRETTKDGKLRNWRYNSGVNTLKGTLAVNQVPSEGRVVVAQIHAKDAPTPLLKLVYRYAKGTGNIDVEYRVKPKDKKSPVIYTVPKVALNKTFSYSLQMDKQGKLTVLINNVGKQVKLDRAWHGYNFYFKAGVYTLDNVGSSSEGGKVTYTKLDVSHK

SEQ ID NO: 3517 - protein, 218 aa, Pseudomonas sp.
MIDLTVWNLTLPIQTPALTVATKAVPTLRNAYFTNTGDKIVFWAPVTGSHTGKSEYPRSELRETSKDGKLRNWRYNSGINSLKGTLSVNQVPSVGRVVVAQIHAKDAPAPLLKLVYRFAKGSGNLDVEYRVKPKDAKSPVIFTVPNVALNKVFTYSLQMDKQGQLSVLINNAGKQVKLDPSWYGYNFYFKAGVYTLDNVGYSTEGGKVTYTKLDVSHK

SEQ ID NO: 3518 - protein, 218 aa, Pseudomonas sp.
MIDLTVWNITLPIQTPALTVATKAVPTLRNQYFTHTGDKIVFWAPVTGSHTGKSKYPRSELRETSKDGKLRNWRFNSGVNTLKGTLAVNQVPSAGRVVVAQIHAKDAPAPLLKLVYRFTKGVGNLDVEYRVKPKDAKSPVMFTVPNVALNKVFTYTLQMDKQGKVTVLINNLGKQVKLDPSWYGYNFYFKAGVYTLDNVGYATEGGKVTYSKLDVSHK

SEQ ID NO: 3519 - protein, 218 aa, Pseudomonas sp.
MIDLTVWNITLPVQTPALTVATKAMPTLQSPYFNRNGERIVFWAPVTGSHTGKSDFPRSELRETGKDGKLRNWRYNSGLNTLNGTLSVNQVPSEGRVVVAQIHAKDAPAPLLKLVYRYAKGTGNLDVEYRVKPKDVKSPVLFSVPNMALNKAFTYALQMDKQGTLTVLINSLGKQVKLNPSWYAYDFYFKAGVYTLDNVGYASEGGKVTYTRLDVGHK

SEQ ID NO: 3520 - protein, 1679 aa, Pseudomonas sp.
MPEPILRPVMPVARDLHLDLLKARVPGWYSAAIVQRQRELSDHTLELPDWYAKAPYETRASLKSSHFRYREILNQVDNVLGDIQDIRAFAEPLLEQAIKAEFKQTLDVNQVYFVRKYGRQVRGDFFGALVLDKGDSQFNQYEYHGSSLLEAALANFEPDEENRPGCADCTLITTQRPFYGGEVMPSTSAFRAGALPIAPQAFARLCRTLDLGRLYQEHINAIVRPPNEASRNQLDRQLRDHHRQGLALSMEIARAKGDISQAAFRMLQQVVGDQDAITLDDRAVTFTSLKVFDIELVGPLLIGPERENSRRVERLVAYFPGDPEQPLKEFASSADFMAQTRRRLHGIGYRRFFSRFVPLRKQGVFFEQFNRFYQPSDLKNSLVDYPLKPNLRRLPMDTSPIPAPLWESLRLRQVQKIQLDARAVAVPTGDEDKKARLARQESYLNAVIDVLNLGAFVVPGLGPLMLTVGAVQMFNEAFEGIEAFERGETREMWAHFSSVALNTAFVATGAAVLPHIQWSNTVEQLEPLRLNNGEARLWRPDLAPYRSDLVPSAGAVPDARGLHRVNGRPILALDGQHYEVQLEPATQRYRIRHPSRPDAYQPKLTDNGSGAWRHELEHPHGWTGAKLMKRLGHRVEHFSPAELEQIRIASGTAEDVLRRMHVEGAPMPALLADTLTRFDICRQIETLTAQLQSEEALDYDKAEPMTQLHLLTRYGPWPKGLQLEVVDRSGRRLWHYAPDPQAGAAARGVSLAEANVRTPSVLKNLIEAVDAAGGDLLADASPAIAKTDMPARVRQLRKQLAEIVVREKVSLFNDYYAKQDLSSDPRATLIKSRFPSVPAAAIDQMLALATSAETQQMDAWDFADAAQTKPIPLRIAEELRHFQRTVRMNRAYEGLYQEALATADTPRLALATLETLSGWSDTVRIELRADDLTGDLIGAIGPQGAQQTKYVIKDGGAYKSLDDQGNDLSHWGSLYDALQRALPDAERQAMGRPSIHQGDLLKQAIGAAPASRDSLASLLKLPPVMPSYKSPMRLASGQVGYPLGGLRERLGLSRSPQSRVLELYPDYTEQEVQALLEAFGDGAVAELKRRKVELQMLDRDLDLWANTPGWREVGRQRHQLVEPQARRAVAERIKRCWRRQVPVVTAVDGSRVGYELVLSQQYVGELPDLTANFSHVASLKLNDMGLTQEGSESFLTGFSSLRWLDMTLNRLTDVPAALGAMNGLTRLQLGSNQIRLTSRSVGTLQDLTQLKILNLENNPLDRLPDFSHFPALRGLYLKSTDISVWPRGLGELPLERVDLRDNRLTEVPDDLIDPPPARALITARLNGVTLLQGNPLSELTQQRLGEYWANISLTHPQWMALRSPGAFGHALPGRPSNVQQWLRNLPSTELEARKDLWRSLAREPQSKELFRLLNRLAGSYQGEENYPDLQARVWQMLEAARDSTQLRRELFELAGAPACEDRAALSFSYLEIRLMIHNARALAGGTDEAAVLVRLAKGLFRLDEVERIALQDIQQRRDAINARRDLTAAQKAQHLQQIEEVEVRLAYRVGLKARLELPKQPAGGRFLMLAGVTQEALDAAAEQVLALDDSPEQFQSLVGRDFWIDYLKEHHPTSFQALTDTLIANQIELDEAKAAGTLEAADYASQSEALALQFKVKEAELIQSLTQSELDALPESTEL

SEQ ID NO: 3521 - protein, 1679 aa, Pseudomonas sp.
MPEPILPLVKPGTRGLHLDLLKTRIPGWYSDAIVQRQRELSGHALELPDWYATAAHETRSSLKSSHSRFRETLNQIDNALGDIQDIRAFAEPLLNQAIQAEFKQTLDVNQVYFVRKYGRQVRSDFFGALVLDKGDSQFNQYEYHGSSLLEAALANFEPDEENRPGCADCTLITTQRPFYGGQVMPSTSAFRAGALPIAPEAFARLCRTLDLGRQYQEHINAIVRPADEASRDALDRQLRDHHRQGLALSMEVARAKGDISQAAYRMLQQVIGDQDAITLDDRAVTFTSLSVFDIELVGPVLIGPERENSRRVERLVAYLPGDPEQPLKEFASSADFMAETRRRLHGIAYRRFFSRFVPLRKQGVFFEQFNRFYQPSDLKNSLVDYPLKPNLRRLPMDTSPIPAPLWESLRLRQVQKIQLDARAVAVPTGDEDKKARLARQESYLNAVVDVLNLGAFVVPGLGPLMLTVGAVQMFNEAFEGIEAFERGETQEMWAHFSSVALNTAFVATGAAVLPHIQWSNAVEQLEPLRLDNGESRLWRPDLAPYRSDLVPPAGAVPDARGLHRVNGRQILALDGQHYEVQLDPATQRYRIRHPSRPDAYQPKLTDNGSGAWRHELEHPHGWTGAKLMKRLGHRVEHFSPAELEQIRIASGTAEDVLRRMHVEGAPMPALLADTLTRFDICRQIETLTAQLQSEEALDYDKAEPMTQLHLLTRYGPWPKGLQLEVVDRSGRRLWHYTPGPQAGAAARGVSLAEANVRTPSVLKNLIEAVDAAGGDLLADASPAIAKTDMPARVRQLRKQLAEIVVREKVSLFNDYYAKQDLSSDPRATLIKSRFPSVPAAAIDQMLARATSAETQQMAEWDFADAAQTKPIPLRIAEELRHFQRTVRMNRAYEGLYQEPLATADTPRLALATVKTLAGWSDTVRIELRADDITGDLIGAIGPQGAEQTKYVIKDGGAYKSFDDQGNDLSHWGSLYDALQRALPDAERQAMGRPSIHQGDLLKQAIGAAPASRDFLANLLKLPPVKPSYKSPMRLASGQVGYPLGGLRERLGLSRSPQRRVLELYPDYTEQEVQALLEALGDGAVAELKRRKVELQMLDRDLDLWASTPGWREVGRQRHQLVDPQARRPVAEQIKRCWRRQVPVVTAVDGSRVGYELDLSQHSVGALPDLTADFSHVASLKLNDMGLTQVGSESFLAGFASLRWLDMTLNRLTDVPAALGAMNGLTRLKLGSNQIRLSSRSVGTLQDLTQLKILNLENNPLDRLPDFSHFPALRGLYLKSTDISVWPRGLGELPLERVDLRDNRLTEVPDDLIDPPPSRALITARLNGVTLLQGNPLSELTQQRLGEYWMNISLSHPQWMALRSPGAFGHALPDRPSNVQQWLRHLPSSELEARKALWRSLAREPQSKELFRLLNRLAGSYQGEENYPDLQARVWQMLEAARDSTQLRRELFELAGAPACEDRAALSFSYLEIRLMIHNARALAGGTDEAAVLVRLAKGLFRLDEVERIALKDIQQRRNAIKARRDLTAAQKARHLQQIEEVEVRLAYRVGLKERLELPKQPKGGRFLMLAGVTQEALDAAAEQVLALDDSPEQFQSLVGRDFWIDYLKEHHPTSFQALTDTLIAKQIELDEAKAAGTLEAADYASQSEALALQFKVKEAELIQSLTQSELDALPESTEL

SEQ ID NO: 3522 - protein, 1364 aa, Pseudomonas sp.
MAYLPGDPEQPLKEFASSADFMAQTRRRLRGIGYRRFFSRFVPLRKQGVFFEQFNRLYQPSEQENSLVDYPLKSNLRRLPMDTSPIPAPLWESLRLRQVQKIQLDARAVAVPTGDEDKKARLARQESYLNAVIDVLNLGAFVVPGLGPLMLTVGAVQMFNEAFEGIEAFERGETREMWAHFSSVALNTAFVATGAAVLPHIQWSNTVEQLEPLRLNNGEARLWRPDLAPYRSDLVPSAGAVPDARGLHRVNGRPILALDGRHYEVQLEPATQRYRIRHPSRPEAYQPKLTDNGSGAWRHELEHPHGWAGAKLMKRLGHRVEHFSTAELEQIRIASGTGEDVLRRMHIEGAPMPALLADTTTRFDICRQIETLTAQLQSEEALDYDKAEPMTQLHLLTRYGPWPKGLQLEVVDRSGRRLWHYAPDPQAGAAARGVSLAEANVRTPSVLKNLIEAVDAAGGDLLADASPAIAKTDMPARVRQLRKQLAEIVVREKVSLFNDYYAKQDLSSDPRATLIKSRFPSVPAAAIDQMLALATSAETQQMDAWDFADAAQTKPIPLRIAEELRHFQRTVRMNRAYEGLYQEPLATADTPRLALATLETLSGWSDTVRIELRADDLTGDLIGAIGPQGAQQTKYVIKDGGAYKSLDDQGNDLSHWGSLYDALQRALPDAERQAMGRPSIHQGDLLKQAIGAAPASRDSLASLLKLPPVMPSYKSPMRLASGQVGYPLGGLRERLGLSRSPQSRVLELYPDYTEQEVQALLEAFGDGAVGELKRRKVELQMLDRDLDLWANTPGWREVGRQRHQLVEPQARRAVAERIKRCWRRQVPVVTAVDGSRVGYELVLSQQYVGELPDLTANFSHVASLKLNDMGLTREGSESFLTGFSSLRWLDMTLNRLTDVPAALGAMNGLTRLQLGSNQIRLTSRSVGTLQDLTQLKILNLENNPLDRLPDFSHFPALRGLYLKSTDISVWPRGLGELPLERVDLRDNRLTEVPDDLIDPPPARALITARLNGVTLLQGNPLSELTQQRLGEYWANISLTHPQWMALRSPGAFGHALPGRPSNVQQWLRNLPSNELEARKDLWRSLAREPQSKELFRLLNRLAGSYQGEENYPDLQARVWQMLEAARDSTQLRRELFELAGAPACEDRAALSFSYLEIRLMIHNARALAGGTDEAAVLVRLAKGLFRLDEVERIALQDIQQRRDAINARRDLTAAQKAQHLQQIEEVEVRLAYRVGLKGRLELPKQPAGGRFLMLAGVTQEALDAAAEQVLALDDSPEQFQSLVGRDFWIDYLKEHHPTSFQALTDTLIANQIELDEAKAAGTLEAADYASQSEALALQFKVKEAELIQSLTQSELDALPESTEL

SEQ ID NO: 3523 - protein, 1680 aa, Pseudomonas sp.
MPEPILGPVRPESRGLHLDLLKARIPGWYSGAIVQRQQELSDHELELPDWYVKTSHETRTSLKHSHSRYRETLNQIDNVLGNIQDLRAFAEPLLTQAIQTEFKQTLNVNQVYFVRKYGLKMRDDFFGALVLDNEGSHFDRYEYRGTSLLEAALANFEPDEENKPGCTDCNLITTVRPFYGGEVVPSINAFRAGELPIAPEAFARLCRKLDLGHRYQEHINAIVRPINHEVRSQLDRQLRDHHKEGLALCVEVARAKGDISVAVYRMLQQVVSDQRAILLDGRAVTFTSLSIFGIELVGPVLIGPGRESSRRAERVVAYMPGDPEQPLKEYASSAEFMVDLRRRLHGIAYRRFFSRFVPLRQQGAFFEQFNHLYQSSTEADDQVDFPLKSSLRNLPMATAAFPEPLWESLRLRQIQKIQVDARAVAVPTGDEDKKARLARLDSYLDAVIDVFNLAAFVVPGLGPLMLTVGAVQMFNEAFEGIEAFERGETREMWAHFSSVALNTAFVATGAAVLPHIQWSSTVDQLEPVQLANGESRLWRPDLTPYQSVREPPATSVPDAQGLYRVDGRDVVPLDGQYYEVQQEPTTRRYRIRHPSRGPDAYQPGLTDNGSGAWSHELEQPRSWEGATLMRRLGHCVKDFSDADLEQIRTASGTSEEVLRRLHVEGEPMPALLADTIKRFDLCRQVDRFIEQLQSEDPLRYEAADPMTQLHLLAGYGPWPKGLRLTVVDGSGKTLWEYARPSEGGAPVRDVIIPEGKVRTPSVLKNLIQAVDAAGGDLLVGTTPAIAKTNMDARVRQLRKKLAAVVAREKVQLFNDHYAKGDVSSDPRATLIKSRFPSVPAAAIDQIVAFASPTEHQQMAAWDFTDATQTKPIPLRIAEELRDYQRALRLNRAYEGLHRETLATADTPRLALATLKTLPGWSDTVRIELREDDVSGVVIGSIGPQDPTQTKIVVKDDDRYKAFDDNGNDLSHWGSLYDALQHALPDAERQAMGRPSMHQGNLLQAAIGATPLDQVALAQLLKMPPLKPSFKSPMRLASGKVGYPMSGVRDRLGLGRSRERRVLDLYPDYTSEQVQSLLRSLGDEAVPELKRRKIELDTLRRDLDHWASLPLMLDVGNDRIRRVPPAVRQGVAERIKRCWRRQTPVVTAVDGSRVGYELDLSGQDVGTLPGLSADFSHVASLKLRDMRLSESSCDRFLTGFSSLRWLDMSSNRLTDIPASLGLMNGLTRLQLRSNQIRLTPRGIQILEGRASLKILNLDHNSLGRLPDFSPLTNLRGLSLRDTGIDTWPTGLRDQPLEQIDLRNNQLTDVPADLTSPPVERAHATARVNGVTLIQGNPLSEATQQRLRDYWTNLFPLHPEWVALRLYGAFEPAPAQRLSNVDLWLRDLPTEQLQDKKALWQSLKAEAQSREFFQLLNRLAGSYQEVENYPDLQARVWQMLEAIRDCTELRRELFDLAGAPACEDRAALSFSYLEIKLMIHNAKALTVGEQEAVALIRLAKGLFRLDEVERIALQDIQQRRDTINARRDLTTAQKNRLIRQIEEVEVRLAYRVGLKGRLELPGQPKGGRFIQMAGVTAEMLNAAAAEIIALDDSPKQLQSLVGRDFWIDYVKQKRASLFQAMNDALIANQLELDEAKAAGTLEEPDYVSQSETLGLQHKVKEAELIQLLTKEELEALVESTDL

SEQ ID NO: 3524 - protein, 1676 aa, Pseudomonas sp.
MPEPILGPVRPESRGMHLDLLKTRIPGWYSGAIVQRQQELSDHVLDLPDWYVKASHETRARLKHSHARYRETLNQIDNVLGNVQDIRAFAEPLLNQAIQDEFKRTQNVNQVYFVRKYGRQARGDFFGALVLDSEGSHFDRYEYHGTSLLEAALANFDADEERKPGCDDCSLITTVRPFYTGEVVPAINAFRAGALPITPEAFARLCRKLDLGRRYQEHINAIVRPIDHQLDRQLRAHHQEGLALCVEVAWAKGDISLAAYRMLQQVVSDQREVMLDGRAVTFTSLNIFGIGLVGPVLIGPDRESSRRVERVVAYLPGDPEQPLKEYASSGEFMVDLRRRLHRVAYRRFFSRFVPLRQLGGFFQRFNRLYQPGAPADDQADYPLKSKLPALPMETSSLPDPLWESLRRRQIQKIQADARAVAVPTGDEDKKARLARLDSYLDAVIDVFNLAAFVVPGLGPLMLTVGAVQMFNEAFEGIEAFERGETREMWAHFSSVALNTAFVATGAAVLPHIQWSSTVEQLEPVQLANGESRLWRPDMVPYRSTLEPPATLVPDTLGLYRVEGRDVVSLDDQNYQVQQDPTTQRYRIRHPSRGPDAYQPGLTDNGSGAWSHELERPRSWEGATLMRRLGHRVKRFSDAELEQIRTASGTSEQVLRRLHVEGEPMPALLADTIKRFDLCRQVDDFIGQLQSEDPLQYEHADPMTQLHLLTGYGPWPKGLKLKVVDGGGRTLWEYVRPSEEGDRVRDVIIPERKVRTPWVLKNLIETVDAAGGDLLAGTSPAIAKTNMDARIQQLRKTLAAVVVREKMHVFNDYYAKEDVSSEPRAALIKSRFPSVPAAAIEQVVAFANPAEQQQMAAWDFADTTQTKPIPLRIAEELRDYQRALRLNRAYEGLYREALVAADTPRLVLATLKSLPGWNDAVRIELRDEVFSGALIDSVGAQDAMQTKVVVKDGERYKAFDDNGNELSHWDSLYEAVQHALPDAERRAMGRPSVHHGALLQKAVGATPLSRASLAKHLQMQPRKSSFKSPMRLASGKVGYPMSGVRGLLGLGRSPERRVLDLYPDYTSEQVQALLRSLGDQAVPELKRRKVELDTLIRDLDRWATTPVWLDAGNDRLEQLLPAIKRGVANRIQWCWRRQGPIVAAVDGSRVGYELNLSGVALGTLPGLSADFSHVVSLKLRSMRLAEPSCDKFLKSFSALRWLDMSFNRLNDLPPSVELMEGLTRLHLAMNEITLSARSIQILEGRTQLKILDLKWNPLGQLPDFSRLPDLRGLNLNGTDISTWPTGLRDLPLEELDLRNNELTEVPTELTDPPAERAHATARVNGVTFVQNNPLNEATQQRLRDYWANLATSHPEWVTFRSPGAFEHVPGGRLSDVDRWLLDLPREQQQDKNTLWRSLEAETQSREFFQLLNRLAGSYQDVENYPDLQARVWQMLEAIRDSTDLRRELFDLAGAPACEDRAALSFSYLEIKLMIHNAKALMVGEQEAVALIRLAKGLFRLDEVERIALQDIQQRRDTINAREDLTAAQKNRLIRQIEEVEVRLAYRVGLKSRLELPGQPKGGRFIQMAGVTAEMLNAAAAEILALDDSPKQLQSLVGRDFWIDYVKQKRASLFQAMNDALIANQLALDEAKAAGTLEEPDYVSQSETLGLQHKVKEAELIQLLTEEELDALVESTDL

SEQ ID NO: 3525 - protein, 182 aa, Pseudomonas sp.
MNKSMLVGAVLGAVAVTAGGAVATYKLVNSGPEYAQVLAVQPVKQQVKTPREVCKDVTVTRQAPVKDQHQIAGTVVGALAGGLLGNQIGGGTGKKIATVAGAVGGGYAGNKVQEGMQERDTYTTTQTRCNTVNDISEKVVGYDVKYELNGKQGQVRMDRDPGSQIPVNKDGQLILGQNVPAQ

SEQ ID NO: 3526 - protein, 182 aa, Pseudomonas sp.
MNKSLLVGAVLGAVGVTAGGAVATYSLVKSGPEYAQVLAVEPVKQQIKTPREVCKDVTVTRQRPVQDQHQIAGTVVGALAGGLLGNQIGGGTGKKIATVAGAVGGGYAGNKVQEGMQERDTYTTTQTRCNTVNDISDKVVGYDVKYELNGKQGQVRMDRDPGSQIPVNKEGQLILGQNQVAH

SEQ ID NO: 3527 - protein, 182 aa, Pseudomonas sp.
MNKSLLVGAVLGAVGVTAGGAVATYKLVKSGPEYAQVLAVEPVKTQIKTPREVCKDVTVTRQAPVKDQHQIAGTVVGALAGGLLGNQIGGGTGKKIATVAGAVGGGYAGNKVQEGMQERDTYTTTQTRCNTVNDISDKVVGYDVRYSLDGKEGKVRMDRDPGNQIPVDKEGRLILGQNEPAK

SEQ ID NO: 3528 - protein, 182 aa, Pseudomonas sp.
MNKSLLVGAVLGAVGVTAGGAVATYSLVKSGPEYAQVLAVEPVKTQIKTPREVCKDVTVTRQAPVKDQHQIAGTVVGALAGGLLGNQIGGGTGKKIATVAGAVGGGYAGNKVQEGMQERDTYTTTQTRCNTVNDISDKVVGYDVRYSLDGKEGKVRMDRDPGNQIPVDKEGKLILSQNEPGQ

SEQ ID NO: 3529 - protein, 182 aa, Pseudomonas sp.
MNKSMLVGAVLGAVGVTAGGAVATYSLVKSGPEYAQVLAVEPVKTQIKTPREVCKDVTVTRQKPVQDQHQIAGTVLGAVAGGLLGNQIGGGTGKKIATVAGAAGGGYAGNKIQEGMQERDTYTTTQTRCNTVNDISDKVVGYDVRYMLDGKEGKVRMDRDPGNQIPVSKEGQLILGQNEPAQ

SEQ ID NO: 3530 - protein, 183 aa, Pseudomonas sp.
MNKSMLVGAVLGAVGVTAGGAVATYSLVKKSSPEYAQVLAVEPVKTQIKTPREVCKDVAVTRQAPVKDQHQIAGTVVGALAGGLLGNQIGGGTGKKIATVAGAVGGGYAGNKVQEGMQERDTYTTTQTRCNTVNDISDKVVGYDVRYSLDGKEGKVRMDRDPGNQIPVDKEGKLVLGQNEENR

SEQ ID NO: 3531 - protein, 184 aa, Pseudomonas sp.
MNKSLLVGAVLGAVGVTAGGAVATYSLVKSGPEYAQVLAVQPVKQQIKTPREVCKDVAVTRQRPVKDEHQILGTVAGAVGGGLLGSMIGNGNGKKLATVAGAVGGGYAGNKVQEGMQERDTYTTTQTRCNTVNDISEKVVGYDVKYDLGGKQGQVRMDRDPGNQIPVDKEGRLILGQNQNQPGQ

SEQ ID NO: 3532 - protein, 182 aa, Pseudomonas sp.
MNKSLLVGAVLGAVGVTAGGAVATYSLVKSGPEYAQVLAVQPVKTQIKTPREVCKDVAVTRQKPVQDQHQIVGTVVGALAGGLLGNQVGGGNGKKLATVAGAVGGGYAGNKVQEGMQNRDTYTTTQTRCNTVNDISDKVVGYDVRYTLDGKEGSVRMDRDPGNQIPVDKEGRLVIGQNQPQQ

SEQ ID NO: 3533 - protein, 182 aa, unknown
  environmental sample
MNKSLLIGAVLGAVGVTAGGAVATYSLVNKGPEYADVLAAEPIKQQIKTPREVCKDVTVTRQKPVQDQHQIVGSVLGAVAGGLLGNQVGGGNGKKIATVAGAVGGGYAGNKVQEGMQGRDTYTTTQTRCNTVNDISDKVVGYNVKYQLDGKVGQVRMDRDPGSQIPVNKQGQLILGENQAGQ

SEQ ID NO: 3534 - protein, 179 aa, unknown
  environmental sample
MNKSMLVGAVLGAAVVTAGGAVATYSLVKGGPEYADVLAVEPINQQIKTPREVCKDVTVTRQAPVKDQHQIVGSVIGAVAGGLLGNQIGGGNGKKIATVAGAVGGGYAGNKVQEGMQERDTYTTTQNRCTTVNDVSDKVVGYNVKYKLNEKVGQVRMERDPGSQIPVDKNGQLILGQAQ

SEQ ID NO: 3535 - protein, 178 aa, unknown
  environmental sample
MNKSLLVGAVLGAVAVTAGGAFATYSLVNSGPEYAEVLAVDPVKQQIKTPREVCKDVTVTRKAPVKDEHQIVGSVLGAVAGGLLGNQVGGGNGKKIATVAGAVGGGYAGNKVQEGMQNRDTYTTTQTRCNTVNDISDKVVGYNVKYKVGEKVGQVRMDRDPGNQIPVDKNGQLVLSQQ

SEQ ID NO: 3536 - protein, 191 aa, Pseudomonas sp.
MYGQEVHVNKSLLVGAVLGAVGVTAGGAVATYSLVKSGPEYAQVLAVQPVKQQIKTPREVCKDVAVTRQRPVKDEHQILGTVAGAVGGGLLGSMIGNGNGKKLATVAGAVGGGYAGNKVQEGMQERDTYTTTQTRCNTVNDISDKIVGYDVKYDLGGKQGQVRMDRDPGNQIPVDKEGHLILGQNQNQPGQ

SEQ ID NO: 3537 - protein, 176 aa, Pseudomonas sp.
MLVGAVLGAVGVTAGGAVATYSLVNKGPEYAQVTDVQPIKQQVKTPREVCKDVTVTRQAPVKDQHQIAGTVVGALAGGLLGNQIGGGTGKKIATVAGAVGGGYAGNKVQEGMQERDTYTTTQTRCNTVNDISEKVVGYNVTYSIGDQVGKVKMDREPGSTIPLDKNGKLILSEAGQ

SEQ ID NO: 3538 - protein, 176 aa, Pseudomonas sp.
MLVGAVLGAVGVTAGGAVATYSLVNKGPEYAQVTDVQPIKQQVKTPREVCKDVAVTRQAPVKDQHQIAGTVVGAIAGGLLGNQIGGGTGKKIATVAGAVGGGYAGNKVQEGMQERDTYTTTQTRCNTVNDISEKVVGYNVTYSIGDQVGKVKMDREPGSTIPLDKNGKLILSEAGQ

SEQ ID NO: 3539 - protein, 180 aa, unknown
  environmental sample
MNKSMLVGAVLGAVGVTAGGAVATYSLVDRGPDYAEVLAVTPINETVKTPREVCKDVAVTRQRPVQDQHQIAGTAIGAIAGGLLGNQVGGGTGKKIATVAGAVGGGYAGNKIQEGMQQRDTYTTTETRCNTVTDTSEKLVGYDVKYQLGEKVGTVRMDRDPGSRIPVNKQGELVLVQQAQ

SEQ ID NO: 3540 - protein, 180 aa, Pseudomonas sp.
MNKSMLVGAVLGAVGVTAGGAVATYSLVDRGPDYAEVLAVTPINETVKTPREVCKDVTVTRQRPVQDQHQIAGTAIGAIAGGLLGNQVGGGTGKKIATVAGAVGGGYAGNKIQEGMQQRDTYTTTETRCNTVTDTSEKLVGYDVKYQLGEKVGTVRMDRDPGNRIPVNKQGELVLVQQTQ

SEQ ID NO: 3541 - protein, 193 aa, Pseudomonas sp.
MAQSCCVSIGQEVQVNKSMLVGAVLGAAVVTAGGAVATYSLVKGGPEYADVLAVEPINQQIKTPREVCKDVTVTRQAPVKDQHQIVGSVIGAVAGGLLGNQIGGGNGKKIATVAGAVGGGYAGNKVQEGMQERDTYTNTQNRCTTVNDVSDKVVGYNVKYKLNEKVGQVRMERDPGSQIPVDKNGQLILGQAQ

SEQ ID NO: 3542 - protein, 196 aa, Pseudomonas sp.
MNKSMIVGAVLGAVGVTAGGAVATYNLVGNSGPEYAEVLAVQPINETIQTPREVCNDVAVTRQRPVKDQHQIAGTVLGAVAGGLLGNQIGGGNGKKIATVAGAVGGGYAGNKVQEHMQEGDTYTTTETRCKIVTDTSEKLVGYDVRYELDGKVGQVRMDHDPGRQIPVTKEGQLILSQQGGVGSSPSQGGGAGVQQ

SEQ ID NO: 3543 - protein, 165 aa, Pseudomonas sp.
MVTAGGAVATYSLVKGGPEYADVLAVEPINQQIKTPREVCKDVTVTRQAPVKDQHQIVGSVIGAVAGGLLGNQVGGGNGKKLATVAGAVGGGYAGNKVQEGMQERDTYTTTQNRCTTVNDVSDKVVGYNVKYKLNEKVGQVRMASDPGSRIPVDKEGQLILGQAQ

SEQ ID NO: 3544 - protein, 177 aa, unknown
  environmental sample
MNKSLLTGAVLGAVVVTAGGAFATYSLVKSPDSAQVLAVEPINQQIKTPRQECKDVAVTHRRAVKDQHQIVGSVLGAVAGGLLGNQIGGGHGKTLATVAGAAGGGYAGNKVQENMQNGDTYTTTETRCNTVNDISDKVVGYNVKYQLDGKVGQVRMDHEPGSSIPVDKQGQLVLGQK

SEQ ID NO: 3545 - protein, 178 aa, Pseudomonas sp.
MNKSLLVGAVLGAVGVTAGGAVATYSLVKSGPEYAEVLAVDPINQEIKTPRKECHDVAVTHRKPVQDQHQVAGTVIGAVGGGLLGHLVGGGKGKTLATVAGAVGGGYAGNKVQEHMQNGDTYTTTESRCNTVNDISNQVMGYNVKYQLNGQVGQVKMDRDPGSKIPVNKDGQLVLTQQ

SEQ ID NO: 3546 - protein, 161 aa, Pseudomonas sp.
MATYSLVNKGPEYAQVTDVQPIKQQVKTPREVCKDVTVTRQRPVQDQHQIAGTVVGALAGGLLGNQIGGGTGKKIATVAGAVGGGYAGNKVQEGMQERDTYTTTQTRCNTVNDISDKVVGYTVKYTIGDQAGVVKMDHEPGSTIPLDKNGKLVLSQAQPGQ

SEQ ID NO: 3547 - protein, 177 aa, Pseudomonas sp.
MNKSMLVGTALGVVVATAGGAFATYSLVDRGPKFAEVLAVEPIKETIKTPREVCKDVTVTRQKPVQDQHRIAGTAVGAVVGGLLGNQVGGGNGKKIATVAGAVGGGYAGNQVQGKMQASSTYTTTETRCSTVTDTHDKIVGYDVKYDLAGKVGRVQMDRDPGSQIPVQDGQLMLSQQ

SEQ ID NO: 3548 - protein, 173 aa, Pseudomonas sp.
MLVGTALGVVVATAGGAFATYTLVDRGPKFAEVLAVEPVKETIRTPREVCKDVTVTRQKPVQDQHRIAGTAVGAVVGGLLGNQVGGGTGKKIATVAGAVGGGYAGNQVQERMQANSTYTTTETRCDTVTDSHDKIVGYDVKYDLDGKVGRVRMDRDPGSQIPVRDGELVLTQQ

SEQ ID NO: 3549 - protein, 68 aa, Pseudomonas sp.
MKIDPLISATLARLEPNQVGVLAWSLLAHPSVAGGIPGQPDPDTPQPAEPTEPGEPTLPDEPPPAPVA

SEQ ID NO: 3550 - protein, 68 aa, Pseudomonas sp.
MKIDPLISATLARLEPNQVGVLAWSLLAHPSVAGGIPGQPDPDTPQPAEPNEPGEPTLPDEPPPAPVA

SEQ ID NO: 3551 - protein, 68 aa, Pseudomonas sp.
MKIDPLISATLARLEPNQVGVLAWSLLAHPSVAGGIPGQPDPDYPQPTEPTEPGEPTLPDEPPPAPVA

SEQ ID NO: 3552 - protein, 68 aa, Pseudomonas sp.
MKIDPLISATLARLEPNQVGVLAWSLLAHPSAAGGIPGQPDPDTPQPSEPSEPGEPTLPDEPPPAPVA

SEQ ID NO: 3553 - protein, 68 aa, Pseudomonas sp.
MKIDPLVSAAIARLEPNQVGVLAWSLLAHPSVAGGIPGQPDPDSPQPAEPTEPGEPTLPDEPPPAPVA

SEQ ID NO: 3554 - protein, 70 aa, Pseudomonas sp.
MKIDPRISATLARLEPNQVGVLAWSLLAHPPVDMAGGIPGQPDPDTPQPAEPSEPGEPTLPDEPPPAPVA

SEQ ID NO: 3555 - protein, 70 aa, Pseudomonas sp.
MKIDPRISATLARLEPNQVGVLAWTLLAHPPVSMAGGIPGQPDPDSPQPLEPTEPGEPTLPDEPPPAPVA

SEQ ID NO: 3556 - protein, 69 aa, Pseudomonas sp.
MKIDPRISAELARLEPNQVGVLAWSLLAHPANMAGGIPGQPDPDTPQPNQPTEPGEPTLPDEPPPVPVA

SEQ ID NO: 3557 - protein, 68 aa, Pseudomonas sp.
MKIDPRISAELARLEPNQVGVLAWSLLAHPPIMAGGIPGQPDPDTPNEQPTEPGEPTLPDEPPPAPVA

SEQ ID NO: 3558 - protein, 68 aa, Pseudomonas sp.
MKIDPRISAELARLEPNQIGVLAWSLLAHPVEAAGGIPGDPDPDPNPTEPTEPGEPTLPDEPPPAPVA

SEQ ID NO: 3559 - protein, 71 aa, unknown
  environmental sample
MKIDPRISAELARLEPNQIGVMAWSLLAHPAEAAGGIPGQPDPDTPNEQPNDPTEPGEPTLPDEPPPAPVA

SEQ ID NO: 3560 - protein, 68 aa, Pseudomonas sp.
MKIDPRISAELARLEPNQIGVMAWSLLAHPAEAAGGIPGQPDPDTPNEQPTEPGEPTLPDEPPPAPVA

SEQ ID NO: 3561 - protein, 66 aa, Pseudomonas sp.
MKIDPSIRAQLANLEPNQVGMLAWSLLAHPQIQAGGIPGQPDPDTPQPTEPGVPTLPDEPPPAPVA

SEQ ID NO: 3562 - protein, 69 aa, Pseudomonas sp.
MKIDPRISAELARLEPNQIGVLAWSLLANPSLSLSGGVPGQPDPDTPNEQPTEPGEPTLPDEPPPAPVA

SEQ ID NO: 3563 - protein, 65 aa, unknown
  environmental sample
MKINPRISAELARLEPNQIGVLAWSLMADPAYAGGIPGQPEPDYPQPTEPGEPTLPDEPPPAPVA

SEQ ID NO: 3564 - protein, 66 aa, Pseudomonas sp.
MKIDPSIRAQLASLEPNQVGLLAWSLLAQPQVQAGGIPGQPDPDTPLPTEPGVPTIPDEPPPAPVA

SEQ ID NO: 3565 - protein, 65 aa, Pseudomonas sp.
MKIDPRISAELARLEPNQIGVLAWSLMADPAYAGGIPGQPDPDFPEPTEPGEPTLPDDPPPVPMA

SEQ ID NO: 3566 - protein, 67 aa, Pseudomonas sp.
MKLDPRISAELARLEPNQIGVMAWSLMADPAAGGIPGQPGPDDPWPNQPEEPGEPTLPDEPPPAPVA

SEQ ID NO: 3567 - protein, 65 aa, Pseudomonas sp.
MKIDPRISAELARLEPNQIGVLAWSLMADPAYAGGIPGQPGPDYPQPGEPGEPTRPDEAPPVPVA

SEQ ID NO: 3568 - protein, 77 aa, Pseudomonas sp.
MKLDPTISAKLAVLQPNSVGVLAWSLLAHPHPHSVQAGGVPGQPDPDTPDSPQPGEHPPMEPGEPTLPDEPPPAPIA

SEQ ID NO: 3569 - protein, 74 aa, Pseudomonas sp.
MKLDPTISAKLALLQPNQIGLLAWSLLAHPPLQAGGVPGQPDPDTPQPPQPGDTPPMEPGEPTLPDEPPPAPVA

SEQ ID NO: 3570 - protein, 75 aa, Pseudomonas sp.
MKLDPAISAKLAVLQPNQIGLLAWSLLAHPAPMHLGGVPGQPDPDTPQPAQPGDTPPMEPGEPTLPDEPPPAPVA

SEQ ID NO: 3571 - protein, 68 aa, Pseudomonas sp.
MKIDPSISAQLAKLEPNQVGLLAWSLLAHPHNLAGGIPGQPEPDTPDEQPIKPVLPDRPDEPPPTPVA

SEQ ID NO: 3572 - protein, 75 aa, Pseudomonas sp.
MKLHPAISAKLAGLQPNQVGMLPWSLLAHPLPMQAGGVPHQPDPDTPQPPEPGETQPMEPGEPTLPDEPPPAPVA

SEQ ID NO: 3573 - protein, 73 aa, Pseudomonas sp.
MKASTLLLAGLMIASSGAAFAEGGAERMKHYWDNFPISQQIPRTDSEQTSSENGKKPQAPAEDPTRASAQPDA

SEQ ID NO: 3574 - protein, 73 aa, Pseudomonas sp.
MKASTLLLAGLMIASSGAAFAEGGAERMKHYWDNFPISQQIPRTDSEQTSSENGKKTQAPAEDPTRATAQPDA

SEQ ID NO: 3575 - protein, 73 aa, Pseudomonas sp.
MKASSLLLAGLLLASSGAAFAEGGAERMKQYWDNFPISQQIPRTDTEQASSDNGKKAQAPTADPARDNARPDA

SEQ ID NO: 3576 - protein, 72 aa, Pseudomonas sp.
MKTSTLLLAGLMLASSGAAFAEGGAERMKHYWDNFPISQQASRTDTQQASSETGKPTQPSEDQVRATAQPDA

SEQ ID NO: 3577 - protein, 95 aa, Pseudomonas sp.
MRTLNRLLLASLIAIAPMAVIAAEDAPSADPEVTIRTEGDKTIQEYRQNGFLYAIKVTPKGGKPYFLVRADGSDGNFIRSDQPDMLIPAWKIFEW

SEQ ID NO: 3578 - protein, 95 aa, Pseudomonas sp.
MRTLNRLLLAGLIAIAPMAVIAAEDAPSADPQVTIRTEGDKTIQEYRQNGFLYAIKVTPKGGKPYFLVRADGSDGNFIRSDQPDMLIPAWKIFEW

SEQ ID NO: 3579 - protein, 95 aa, Pseudomonas sp.
MRTLNRLLLASLIAIAPMAVIAAEDAPSADPDVTIRTEGEKTIQEYRQNGFLYAIKVTPKGGKPYFLVRADGSDGNFIRSDQPDMLIPSWKIFEW

SEQ ID NO: 3580 - protein, 95 aa, Pseudomonas sp.
MRTLNRLLLASLIAVTPLAVIAAEDAPSADPDVTIRTEGDKTIQEYRQNGFLYAIKITPKGGKPYFLVRADGSDGNFIRSDQPDMLIPAWKIFEW

SEQ ID NO: 3581 - protein, 95 aa, Pseudomonas sp.
MRTLNRLLLTGLIAIAPLAAIAAEDAPSADPEVTIRTEGDKTIQEYRQNGFLYAIKITPKGGKPYFLVRADGSDGNFIRSDQPDMLIPSWKIFEW

SEQ ID NO: 3582 - protein, 95 aa, Pseudomonas sp.
MRTLNRLLLAGLFAITPLAVMAADDAPSADPDVTIRTEGDKTIQEYRQNGFLYAIKVTPKVGKPYFLVRADGSDGNFIRSDQPDMLIPSWKIFEW

SEQ ID NO: 3583 - protein, 95 aa, Pseudomonas sp.
MRTLNRLLLAGLFAITPLAVMAADDAPSADPDVTIRTEGDKTIQEYRQNGFLYAIKVTPKGGKPYFLVRADGSDGNFIRSDQPDMLIPSWKIFEW

SEQ ID NO: 3584 - protein, 95 aa, Pseudomonas sp.
MRTLNRLLLAGLFAITPLAVMAADDAPSADPDVTIRTEGDRTIQEYRQNGFLYAIKVTPKNGKPYFLVRADGSDGNFIRSDQPDMLIPSWKIFEW

SEQ ID NO: 3585 - protein, 95 aa, unknown
  environmental sample
MRTLNRLLLAGLFAFTPLAVMAADDAPSADPDVTIRTEGDNTIQEYRQNGFLYAIKVTPKNGKPYFLVRADGSDGNFIRSDQPDMLIPSWKIFEW

SEQ ID NO: 3586 - protein, 95 aa, unknown
  environmental sample
MRTLNRLLLLCLIAGLPVVTLAADDAPSADPEVTIRTEGDKTIQEYRQNGFLYAIKITPKHGKPYFLVRADGSDGNFIRSDQPDMLIPSWKIFEW

SEQ ID NO: 3587 - protein, 95 aa, unknown
  environmental sample
MRTLNRLLLAGLFAFTPIAVMAADDAPSADPDVTIRTEGDKTIQEYRQNGFLYAIKVTPKNGKPYFLVRADGTDANFIRSDEPDMLIPSWKIFEW

SEQ ID NO: 3588 - protein, 89 aa, Pseudomonas sp.
MLLAGLIAVSSMAAIAAEDAPSADPEVTIRTEGDKTIQEYRQNGFLYAIKVTPKGGKPYFLVRADGSDGNFIRSDQPDMLIPSWKIFEW

SEQ ID NO: 3589 - protein, 95 aa, Pseudomonas sp.
MRTLNRLLLLGLLATTPIVTQAADDAPSADPDVTIRTEGDRTIQEYRQNGFLYAIKITPKNGKPYFLVRADGSDGNFIRSDQPDMLIPSWKIFEW

SEQ ID NO: 3590 - protein, 95 aa, Pseudomonas sp.
MRTLNRLLLVGLIAVSPLAAMAADDAPGGDPEVTIRTDGDKTIQEYRQNGFLYAIKITPKNGKPYFLVRADGTDANFIRSDQPDMLIPSWKIFEW

SEQ ID NO: 3591 - protein, 95 aa, Pseudomonas sp.
MGTFNRLLLLGLLVGTPVAALAADEAPSAEPEVTIRTEGDKTIQEYRQNGFLYAIKVTPKNGKPYFLVRADGSDANFIRSDQPDMLIPSWKIFEW

SEQ ID NO: 3592 - protein, 95 aa, unknown
  environmental sample
MRSFNRLLLLGLLVTLPVVAQAADDAPSADPEVTIRTEGDRTIQEYRQNGFLYAVKVTPKHGKPYFLVRADGTDANFIRSDQPDMLIPAWKIFEW

SEQ ID NO: 3593 - protein, 95 aa, unknown
  environmental sample
MRNVKRLLLATLLLSGPLMVQAADDAPSADPDVTIRQDGDKTIQEYRQNGFLYAIKITPKHGKPYFLVRADGTDDNFIRSDQPDMLIPAWKIFEW

SEQ ID NO: 3594 - protein, 96 aa, Pseudomonas sp.
MRTLNRLLLTGLFAFTPLVTFAADEAVTADPDVTIRTEGDKTIQEYRQNGFLYAIKVTPKGGKPYFLVRADGTDANYIRSDQPDMLIPSWKIFEWK

SEQ ID NO: 3595 - protein, 96 aa, unknown
  environmental sample
MRTLNRLMLAGLLAFAPLVAMAADDDAPSGEPDVTIRQEGDKTIQEYRVNGFLYAIKVVPKHGKPYFLVRADGSDGNFIRSDQPDKLIPQWEIFSW

SEQ ID NO: 3596 - protein, 96 aa, Pseudomonas sp.
MRTLNRLMLAGLLAFAPLVAMAADDDAPPGGPDVTIRQEGDKTIQEYRVNGFLYAIKVVPKHGKPYFLVRADGSDGNFIRSDQPDKLIPQWEIFSW

SEQ ID NO: 3597 - protein, 96 aa, Pseudomonas sp.
MRTLNRLLLAGLFATVPLAAMAADDVSKQEPQVTIRTEGDKVIQEYRQNGFLYAIKVTPKGGKPYFLVRADGTEANYIRSDQPDMLIPAWEIFTWK

SEQ ID NO: 3598 - protein, 96 aa, Pseudomonas sp.
MRSLNRLLLAGFFAITPLAVMAANDAPTPEPEVTIHTEGDKVIQEYRQNGFVYAIKVTPKGGKPYFLIRADGTEANYIRSDQPNMLIPAWEIFTWK

SEQ ID NO: 3599 - protein, 94 aa, Pseudomonas sp.
MRTLNCLLLAGLLGVGATMAHAEDPVTAEPDVTIRQEGDRTVQEYRVNGFLYAIKVIPKNGKPYFLVRSDGSDGNFIRSDDPDMLIPAWEIFSW

SEQ ID NO: 3600 - protein, 94 aa, unknown
  environmental sample
MGTLNRLLLVGLLACVPLAAHAEDPVSGDPDVTIRQDGDRTIQEYRVNGFLYAIKVIPKNGKPYFLVRADGSDGNFVRSDDPDMLIPSWEIFSW

SEQ ID NO: 3601 - protein, 98 aa, Pseudomonas sp.
MRTLNRLLLVGLIAASPLAAMAADDAPASEPEVTINTHTEGDKVIQEYSRSGFVYAIKVTPKGGKPYFLVRADGTDANYIRSDQPDMLIPSWEIFTWK

SEQ ID NO: 3602 - protein, 95 aa, unknown
  environmental sample
MRKVNRLILTGLLAFCPLLAVAAEDPPSAAPDVTIRTDGDRTIKEYRQNGFLYAVKITPKHGKPYFLVRADGTSPNFIRSDQPDMLIPQWEIFSW

SEQ ID NO: 3603 - protein, 95 aa, Azotobacter sp.
MHTFPRLLLAGLLALGAVGAFAQQDAPSGEPDVTIREEDDKTIEEYRVNGFLYAIKVTPKFGKPYFLVRADGNDANFVRSDEPTMRIPAWKIFEW

SEQ ID NO: 3604 - protein, 497 aa, Erwinia sp.
MLPSTRVSAMRKLPLAITLGLVSLATQQAFAHGYIESPKSRAFMCSATGGNLNRDCGPVTYEPQSVEYSPSVQHHYPKDYCSGDFTKCGPANGTIPAGGITNFSQLNEQTATRWQKTTIKPGMNEFTWHYSAGHASAYYQFYITKKDWNPNQPLTRDSFEMTPLLNENAGGVRPPAGGKTQHKVNIPADRSGYHVILATWKIADTAATFYQAIDVNIDNDGAPIPDWKILGAVQPEQLRVGDKVSTRVFTNAGEQQNRQTRLSIETAEQAQANTWPFLLAQQVNKANAGYVMGELNANNEVVPNYGKNTMYAKNNSDVVRVEIQKEQPSIPGELKLSGLQAEYTLKDNATDLHFNAIAQGGKYTISSTVFNGKNESIAHVQAEPGNNTPHFSIPLRNVSEGEYDVVVVAKPEKGEQLQQSQRITLKAEEVGGGGDYDFVFPKGLTGYKAGTKVLAKDGNVYECKPFPYSGYCIQWNAGATQFEPGVGSNWKDAWIRK

SEQ ID NO: 3605 - protein, 497 aa, Pseudomonas sp.
MLPSTRVSAMRKLPLAITLGLVSLATQQAFAHGYIESPKSRAFMCSATGGNLNRDCGPVTYEPQSVEYSPSVQHHYPKDYCSGDFTKCGPANGTIPAGGITSFSQLNEQTATRWQKTTIKPGMNEFTWYYSAGHASAYYQFYITKKDWNPNQPLTRDSFEMTPLLNESAGGARPPAGGRTKHKVNIPADRSGYHVILATWKIADTAATFYQAIDVNIDNDGAPIPDWKILGAVQPEQLRVGDKVSTRVFTNAGEQQNRQTRLSIETAEQAQANTWPFLLAQQVNKANAGYVMGELNANNEVVPNYGKNTLYAKNNSDVVRVEIQKEQPSIPGELKLSGLQAEYTLKDNATDLHFNAIAQGGKYTISSTVFNGKNESIAHVQAEPGNNTPHFSIPLRNVSEGEYDVVVVAKPEKGEQLQQSQRITLKAEEVGGGGDYDFVFPKGLTGYKAGTKVLAKDGNVYECKPFPYSGYCIQWNAGATQFEPGVGSNWKDAWIRK

SEQ ID NO: 3606 - protein, 497 aa, Pseudomonas sp.
MPHNNRVNAMRKLPLAITLGLVSLATQQAFAHGYVESPKSRAFMCSATGGNLNRDCGPVTYEPQSVEYSPSVQHHYPKDYCSGDFTKCGPANGTIPAGGITSFSQLNEQTATRWQKTTIKPGMNEFTWYYSAGHASAYYQFYITKKDWNPNQPLTRDSFEMTPLLNENAGGVRPPAGGRTKHKVNIPADRSGYHVILATWKIADTAATFYQAIDVNIDNDGAPIPDWKILGAVQPEQLRVGDKVSTRVFTNAGEQQNRQTRLSIETAEQAQANTWPFLLAQQVNKANAGYVMGELNANNEVVPNYGKNTLYAKNNSDVVRVEIQKEQPSIPGELKLSGLQAEYTLKDNATDLHFNAIAQGGKYTISSTVFNSKNESIAHVQAEAGNNTPHFSIPLRNVSEGEYDVVVVAKPEKGEQLQQSQRITLKAEEVGGGGDYDFVFPKGLTGYKAGTKVLAKDGNVYECKPFPYSGYCIQWNAGATQFEPGVGSNWKDAWIRK

SEQ ID NO: 3607 - protein, 497 aa, Pseudomonas sp.
MPHNNRVNAMRKLPLAITLGLVSLATQQAFAHGYVESPKSRAFMCSATGGNLNRDCGPVTYEPQSVEYSPSVQHHYPKDYCSGDFTKCGPANGTIPAGGITSFSQLNEQTATRWQKTTIKPGMNEFTWYYSAGHASAYYQFYITKKDWNPNQPLTRDSFEMTPLLNESAGGARPPAGGRTKHKVNIPADRSGYHVILATWKIADTAATFYQAIDVNIDNDGAPIPDWKILGAVQPEQLRVGDKVSTRVFTNAGEQQNRQTRLSIETAEQAQANTWPFLLAQQVNKANAGYVMGELNANNEVVPNYGKNTLYAKNNSDVVRVEIQKEQPSIPGELKLSGLQAEYTLKDNATDLHFNAIAQGGKYTISSTVFNGKNESIAHVQAEPGNNTPHFSIPLRNVSEGEYDVVVVAKPEKGEQLQQSQRITLKAEEVGGGGDYDFVFPKGLTGYKAGTKVLAKDGNVYECKPFPYSGYCIQWNAGATQFEPGVGSNWKDAWIRK

SEQ ID NO: 3608 - protein, 497 aa, Pseudomonas sp.
MPHNNRVNAMRKLPLAITLGLVSLATQQAFAHGYVESPKSRAFMCSATGGNLNRDCGPVTYEPQSVEYSPSVQHHYPKDYCSGDFTKCGPANGTIPAGGITSFSQLNEQTATRWQKTTIKPGMNEFTWYYSAGHASAYYQFYITKKDWNPNQPLTRDSFEMTPLLNESAGGARPPAGGRTKHKVNIPADRSGYHVILATWKIADTAATFYQAIDVNIDNDGAPIPDWKILGAVQPEQLRVGDKVSTRVFTNAGEQQNRQTRLSIETAEQAQANTWPFLLAQQVNKANAGYVMGELNANNEVVPNYGKNTLYAKNNSDVVRVEIQKEQPSIPGELKLSGLQAEYTLKDNATDLHFNAIAQGGKYTISSTVFNSKNESIAHVQAEPGNNTPHFSIPLRNVSEGEYDVVVVAKPEKGEQLQQSQRITLKAEEVGGGGDYDFVFPKGLTGYKAGTKVLAKDGNVYECKPFPYSGYCIQWNAGATQFEPGVGSNWKDAWIRK

SEQ ID NO: 3609 - protein, 496 aa, Pseudomonas sp.
MLHNNRATAMRKLPLAITLGLASLASQQAFAHGYIESPKSRAFMCSANGGNLNRDCGPVTYEPQSVEYSPSVQHHYPKDYCSGDFTKCGPANGTIPAGGITSFSQLNEQTATRWQKTTIKPGMNEFTWYYSAGHASAYYQFYITKKDWNPNQPLTRDSFEMTPLLDEKANGARPPAGGRTKHKVNIPADRSGYHVILATWKIADTAATFYQAIDVNIDNDGAPIPDWKILGAVQPEQLRVGDKVSTRVFTNAGEQQNRQTRLSIETAEQAQANTWPFLLAQQVNKANAGYVMGELNANNEVVPNYGKNTMYAKNNSDVVRVEIQKEQPSIPGELKLSGLQAEYTLKDNATDLHFNAIAQGGKYTIASTVFNGKGESIAHQQAEAGNNTPHFSIALRNVSEGDYDVVVVAKPEKGEQLQQSQRITLKAEEVGGGDYDFVFPKGLTGYKAGTKVLAKDGNVYECKPFPYSGYCIQWNAGATQYEPGVGSNWKDAWIRK

SEQ ID NO: 3610 - protein, 496 aa, unknown
  environmental sample
MLHNNRATAMRKLPLAITLGLASLASQQAFAHGYIESPKSRAFMCSANGGNLNRDCGPVTYEPQSVEYSPSVQHHYPKDYCSGDFTKCGPANGTIPAGGITSFSQLNEQTATRWQKTTIKPGMNEFTWYYSAGHASAYYQFYITKKDWNPNQPLTRDSFEMTPLLDEKANGARPPAGGRTKHKVNIPADRSGYHVILATWKIADTAATFYQAIDVNIDNDGAPIPDWKILGAVQPEQLRVGDKVSTRVFTNAGEQQNRQTRLSIETTEQAQANTWPYLLAQQVNKANAGYVMGELNANNEVVPNYGKNTMYAKNNSDVVRVEIQKEQPSIPGELKLSGLQAEYTLKDNATDLHFNAIAQGGKYTIASTVFNSKGESIAHQQAEAGNNTPHFSIPLRNVSEGDYDVVVVAKPEKGEQLQQSQRITLKAEEVGGGDYDFVFPKGLTGYKAGTKVLAKNGNVYECKPFPYSGYCIQWNAGATQYEPGVGSNWKDAWIRK

SEQ ID NO: 3611 - protein, 498 aa, Pseudomonas sp.
MLPSTRASALRKLPLAITLGLASLATQQAFAHGYVESPKSRAFMCNSAGGNLNGNCGPVTYEPQSVEYSPSVAHHYPKDYCAGDFTQCGPANGTIPAGGIASFSQLNEQTATRWQKTTIKPGMNEFTWHYKAGHASAYYQFYITKKDWNPNQPLTRDSFELTPLLNENAGGARPQSGSTTKHKVNIPADRSGYHVILATWKIADTAATFYQVIDVNIDNDGAPVPDWKILGAVQPEELRVGDKVKTRVFTNAGEQQNRQTVLNIETAEQAKANTWPFLLAQKVNKANAGYLMGELNANNEVVPHYGKNTMYAKKGSDVVNVEIQKDQPSIPGELKISGLQAEYTLKDGATDLHFNAIAQGGKYTVSSTVFNGKNESIAHVQAEPGNNMPHFSIPLRNVSEGEYDVVVVAKPEKGEQLQQSQRITLKAEETGGGTGEYDFVFPKGLSSYKAGTKVLGKDGKVYECKPFPYSGYCIQWNAGAIHYEPGTGSNWQDAWIRK

SEQ ID NO: 3612 - protein, 498 aa, Pseudomonas sp.
MLHNIRANAMRKLPLAITLGLASLATQQAFAHGYVESPKSRAYMCNSAGGSLNANCGAVTYEPQSVEYSPSVAHHYPKDYCAGDFTQCGPANGTIPAGGITSFSQLNEQTATRWQKTTIKPGMNEFTWHYKAGHSSAYYQFYITKKDWNPNQPLTRDSFELKPLLDEKANGVNPGSGGRTKHKVNIPADRSGYHVILATWKIADTAATFYQAIDVNIDNDGAPVPDWKILGAVQPEELRVGDKVKTRVFTNAGEQQNRQTVLNIETADQAKANNWPFLLAQKVNKANAGYLMGELNANNEIVPNYGKNTMYAKKGSDVVNVEIQKDQPSIPGELKISGLQAEYTLKDGATDLHFNAIAQGGKYTVSSTVFNGKNESIAHVQAEPGNNAPHFSIPLRNVSEGEYDVVVVAKPEKGEQLQQSQRITLKAEEVGGGNGDYDFVFPKGLSSYKAGTKVLGKDGKVYECKPFPYSGYCIQWNAGATHYEPGTGSNWKDAWIRK

SEQ ID NO: 3613 - protein, 497 aa, Pseudomonas sp.
MIHSHRSRSMSKLPLALAIGLAALSSQQAFSHGYVESPKSRAYMCNAKGGNLNANCGAVTYEPQSIEYAEGANHHYPSTYCPGDFTQCGPADGTIPAGGLNNFAPLNEQTATRWQKTTLKPGLNEFRWRFTAGHASAYYQFYITKKDWNPNQPLTRDSFELKPLLNQDAGGETPQSGSSKSFNVNIPGDRSGYHVILATWRIANTSATFYQAIDVNIDNNAVPPSEWTSIGTVQPEPLQIGDKVMTRVFTNAGEQANRQTVLDIGSATEAQANTWPFLLAQKANQANAGYRMGVLNADGEVVPNYGANSIYTKAGSDVVRVEIQKDQPTVPGELSLSGLQPSYTLKDGAADLHFTAIAQGGTYTIGATVFNGKGESIAHQQAEAGNNAPHFSIPLRNASAGDYDLVVVAKPEKGELLQETQRFSLKAEDNGGNGKYDFVFPDGLSRYTAGTTVLAKDGNTYACKPFPYSGFCKQWNAGSNQFEPGVGSSWKDAWIRR

SEQ ID NO: 3614 - protein, 497 aa, Pseudomonas sp.
MIHSHRSRSMSKLPLALAIGLAALSSQQAFSHGYVESPKSRAYMCNAKGGNLNANCGAVTYEPQSIEYAEGANHHYPSTYCPGDFTQCGPADGTIPAGGLNNFAPLNEQTATRWQKTTLKPGLNEFRWRFTAGHASAYYQFYITKKDWNPNQPLTRDSFELKPLLNQDAGGETPQSGSSKSFNVNIPGDRSGYHVILATWRIANTSATFYQAIDVNIDNNAVPPSEWTSIGTVQPEPLQIGDKVMTRVFTNAGEQANRQTVLDIGSATEAQANTWPFLLAQKANQANAGYRMGVLNADGEVVPNYGANSIYTKAGSDVVRVEIQKDQPTVPGELSLSGLQPSYTLKDGAADLHFTAIAQGGTYTIDATVFNGKGESIAHQQAEAGNNAPHFSIPLRNASAGDYDLVVVGKPEKGELLQETQRFSLKAEDNGGNGKYDFVFPDGLSRYTAGTTVLAKDGNTYACKPFPYSGFCKQWNAGSNQFEPGVGSSWKDAWIRR

SEQ ID NO: 3615 - protein, 499 aa, Pseudomonas sp.
MNHSTRPLAARMLPLAAALGLAALGAQQASAHGYVDSPKSRAYMCAASGGSLNKDCGSAAWEPQSIEYSPSVGHHYKGRYCADDFTKCGPADGTIPSGGIKGFAKLNEQSATRWQKTTIKPGINDFTWRYTAGHATAYYQFYITKKDWNPNQPLTRESFESKPLLHENANGARPSSGTRTTHKVNIPSDRSGYHVVLATWKIGDTAATFYQAIDVNIDNKGAPPSEWTTIGAVQPEALSIGDKVTTRVFTKAGEQANRQTLLRIDNAQQAQANTWPYLLAQKANQANAGYLMGQLNADGKVVPNYGTNNIYTKAGSDVVRVEIQKEQPSIPAALSLSSLKDSYTLKNGSAELHFNAIAQGGKYTIDATVFNAKGESIAYQQGEAGNNMPHFSLPLKNVQAGEYDLVVLAKPEKGELLQKTHHFTLKDESGNGGGNAKYDYVFPDGVKSYRAGVRVLAKDGNIYECKPFPYGSYCPQWSTGANHFEPGVGQFWSQAWIRK

SEQ ID NO: 3616 - protein, 112 aa, Pseudoxanthomonas sp.
MRKNASILAATLAAVLFSGAAMAQDNDPSKKPAADADSNQPVTDTWITTKVKSSLLADSDVSGTKIEVDTVDGVVFLTGNVDSQAQVNEAKRIASEIDGVGKVDTSRLKVGK

SEQ ID NO: 3617 - protein, 227 aa, unknown
  environmental sample
MSIESQNGVSHRRSRAAVGLAACAVAALSSGVVFAGSASATPTALADKFASTVTDDGWSLDLAATKLSANPVPNLATTAFTREGFVSAKVTGTIGGAGDSAVKTGYVEQGLQIGCQIDVSSGLGLGLGFSLGPSVGVSISGVPSANVGVNASVNPSIQSTIAPGTITTIPLGKKDLESSKASITAENVHVKVDACMGPVTIRSYAQLSVSTATSDNTLFVYSDPTWL

SEQ ID NO: 3618 - protein, 227 aa, Rhodococcus sp.
MATELKARTSRRRSRAAVGLAACAVAALSSGVVFAGSASATPTALSDKFASTVTDDGWSLDLAATKLSANPVPNLATTAFTREGFVSAKVTGTIGGAGDSAVKTGYVEQGLQIGCQIDVSSGLGLGLGFSLGPSVGVSISGVPSANVGVNASVNPSIQSTIAPGTITTIPLGKKDLESSKASITAENVHVKVDACMGPVTIRSYAQLSVSTATSDNTLFVYSDPTWL

SEQ ID NO: 3619 - protein, 227 aa, Rhodococcus sp.
MATELKARTSRRRSRAAVGLAACAVAALSSGVVFAGSASATPMALADKFASTVTDDGWSLDLVATKLSANPVPNLATTAFTREGFVSAKVTGTIGGAGDSAVKTGYVEQGLQIGCQIDVSSGLGLGLGFSLGPSVGVSISGVPSANVGVNASVNPSIQSTIAPGTITTIPLGKKDLESSKASITAENVHVKVDACMGPVTIRSYAQLSVSTATSDNTLFVYSDPTWL

SEQ ID NO: 3620 - protein, 232 aa, unknown
  environmental sample
MATSTPETTRALTGKRRIGKTMGACAAVSSALMAGSVAFAGGASATPTALPDKFASTVTDDGWTLDLAATKLSANPVPNLATTAFTREGFVSAKVTGTISGAGNSAVKTGYVEQGLQIGCQIDVSSGLGVGLGFSLGPSVGVSISGVPSANVGVNASVNPSIQTTIAPGTITTIPLGKKDLEAAKASITAENVHVKVDACMGPVTIRSYAQFAVSTATSDNSVFVYSDPTWL

SEQ ID NO: 3621 - protein, 232 aa, unknown
  environmental sample
MATNTAETVRTLRGKRRIGKAVGTCAAVSSVLMASALAFAGTASATPTALPDKFASTVTDDGWTLDLAATKLSANPVPNLATTAFTREGFVSAKVTGTISGAGDTAVKTGYIEQGLQIGCQIDVSSGLGLGLGFSLGPSVGVSISGVPSANIGVNASVNPSIQTTIAPGTITTIPLGKKDLEAAKASITAENVHVKVDACMGPVTIRSYAQFAVSTATSDNSVFVYSDPTWL

SEQ ID NO: 3622 - protein, 230 aa, Bacillus sp.
MKQIIAMGGGGFSMEPDHLVLDQFIINQSKQPSPRICFLPTASGDAENYVQRFYHAFQKFDCDPSHLSLFKPPTTDLASFIMEKDVIYVGGGNTRNLLVLWKEWGLDHILKKAWENGIILAGLSAGAICWFEEGVTDSAGPLTGLKSLGFLQGSFCPHYDGEKDRRPTYHHMISEKALSSGYAADDGAALHFIDDQFFQAVSSRSDANAYQVVLHENEISEIALPITYLS

SEQ ID NO: 3623 - protein, 230 aa, Bacillus sp.
MKQIIAMGGGGFSMEPDNLSLDQYILNQSKREQPRICFLPTASGDSQNYIQRFYHAFQTLDCVPSHLSLFKPPSTDLASFVMEMDVIYVGGGNTRNLLVLWKEWGLDHILREAWKNGVVLAGLSAGAICWFEEGVTDSAGPLTGLKSLGFLQGSFCPHYDGEKDRRPAYHQLISNKFLCSGYAADDGAALHFINDQLFQTVSSRAGAKAYRVIMGEHEVSEIPLPVKYLG

SEQ ID NO: 3624 - protein, 231 aa, Bacillus sp.
MMKQIIAMGGGGFSMEPDNLSLDQYILNQSKREQPRICFLPTASGDSQNYIQRFYHAFQTLDCVPSHLSLFKPPPSDLASFVMEMDVIYVGGGNTRNLLVLWKEWGLDQILREAWKNGVVLAGLSAGAICWFEEGVTDSAGPLTSLKSLGFLQGSFCPHYDGEKDRRPAYHQLISNKFLCSGYAADDGAALHFINDQLFQTVSSRSGAKAYRVMMAEHEIAEIPLPVKYLG

SEQ ID NO: 3625 - protein, 231 aa, Bacillus sp.
MMKQIIAMGGGGFSMEPDNLSLDQYILNQSKREQPRICFLPTASGDSQNYIQRFYHAFQTLDCVPSHLSLFKPPSSDLVSFVMEMDVIYVGGGNTRNLLVLWKEWGLDHILREAWKNGVVVAGISAGAICWFEEGVTDSAGPLTSLKSLGFLQGSFCPHYDGEKDRRPAYHQLISNKFLCSGYAADDGAALHFINDQLFQTVSSRSGAKAYRVMMAEHEIAEIPLPVKYLG

SEQ ID NO: 3626 - protein, 233 aa, Bacillus sp.
MKQIIAMGGGGFSMEPENLSLDQYILNQSERESPRICFLPTASGDSQNYIQRYYHAFQTMDCVPSHLSLFKPPSTDLTSFIMEKDVIYVGGGNTRNMLVLWKEWGLDFILREAWKNGVILAGLSAGAICWFEEGVTDSAGPLTSMKSLGFLQGSFCPHYDGEKDRRPAYHQMIANEFLCNGYAADDGAALHFINDQLFQTVSSRSDAKAYRVMRDEHGISEISLPVTYLGSIS

SEQ ID NO: 3627 - protein, 234 aa, Bacillus sp.
MMKQIIAMGGGGFSMEPENLSLDQYILNQSERESPRICFLPTASGDSQNYIQRFYHAFQTMDCVPSHLSLFKPPSTDLTSFVMEKDVIYVGGGNTRNMLVLWKEWGLDFILREAWKNGVILAGLSAGAICWFEEGVTDSTGPLTSMKSLGFLQGSFCPHYDGEKDRRPAYHLLIANEFLCNGYAADDGAALHFINDQLFQTVSSRSDAKAYRVMRDEHGISEIPLPVTYLDSIS

SEQ ID NO: 3628 - protein, 231 aa, Bacillus sp.
MKQIIAMGGGGFSMEPDHLLLDQYLLEQTKKSAPRVCFLPTASGDSESYIQRFYHAFQKLECMPDHLSLFKPPSTDLASFICEQDIVYVGGGNTRNLLVLWKEWGLDHILREAWERGVILSGLSAGAICWFKEGVTDSMNGPLTGLNGLGFLQGSFCPHYDGEKERRPAFHRLISEKSLSEGYAADDGAALHFIGNQLFQVVSSRAGAQAYRVTVHENEITEISLPVHDLS

SEQ ID NO: 3629 - protein, 230 aa, Bacillus sp.
MKQIIAMGGGGFSMEPENLSLDQYIINQSERKSPRICFLPTASGDSQSYVQRFYDAFQTLDCVPSHLSLFKPPSTNLTSFLMEKDVIYVGGGNTRNMLVLWKEWGLNLILREAWKNGVVLAGLSAGAICWFEEGVTDSAGPLTSMKSLGFLQGSFCPHYDGEKDRRPIYHELISNEFLCDGYAADDGAALHFVNDQLVQTVSSRPGAKAYRVMMGEHGISETPLPVKSLC

SEQ ID NO: 3630 - protein, 230 aa, Bacillus sp.
MKQIIAMGGGGFSMEPDNLSLDQYIINQTKRKSPRICFLPTASGDSQNYVQRFYHAFQTMDCVPSHLSLCKPLSTDILSFVMEQDVIYVGGGNTRNMLVLWKEWGLDLILREAWKSGVVLAGLSAGAMCWFEEGVTDSAGPLTSMKSLGFLHGSFCPHYDSEKERRPIFHQLICNGFLGDGYAADDGAALHFINDQLFQTVSSRPGAKAYRVTVVEHEIFETRLPVKYLG

SEQ ID NO: 3631 - protein, 250 aa, Bacillus sp.
MKQIIAMGGGGFSMEPDNLSLDQYILNQSKREQPRICFLPTASGDSQNYIQRFYHAFQTLDCVPSHLSLFKPPSSDLVSFVMEMDVIYVGGGNTRNLLVLWKEWGLDHILREAWKNGVVVAGISAGAICWFEEGVTDSAGPLTSLKSLGFLQGSFCPHYDGEKDRRPAYHQLISNKFLCSGYAADDGAALHFINDQLFQTVSSRSGAKAYRVMMAEHEIAEIPLPVKYFRVKLAEYYLYSSFFQIDFMIR

SEQ ID NO: 3632 - protein, 251 aa, Bacillus sp.
MMKQIIAMAGGGFSMEPDNLSLDQYILNQSKREQHRICFLPTASGDSQNYIQRFYHAFQTLDCVPSHLSLFKPPSSDLVSFVMEMDVIYVGGGNTRNLLVLWKEWGLDHILREAWKNGVVVAGISAGAICWFEEGVTDSAGPLTSLKSLGFLQGSFCPHYDGEKDRRPAYHQLISNKFLCSGYAADDGAALHFINDQLFQTVSSRSGAKAYRVMMAEHEIAEIPLPVKYVRVKLAEYYLYSSFFQIDFMIR

SEQ ID NO: 3633 - protein, 232 aa, Bacillus sp.
MKQIIAMGGGGFSMEPDHLVLDQYILEQSARSKPKICFLPTASGDSENYIGRFYQAFQKLRCEPDHLSLFKPPGSDLRSFLMKKDIIYVGGGNTRNMLVLWKEWGLDLILREAWENGIMLAGLSAGAICWYEEGVTDSAGDLRELRALGFLRGSFCPHYDGEAERRPVYHRLISEKKLREGYAADDGAALHYKDGQLFRAVSSRETAKGYRVFNTEKGVRETELMTLPLSEF

SEQ ID NO: 3634 - protein, 481 aa, Salinibacillus sp.
MKKKLAAGLTASAIVSTTLAITPAEAATIKVKSGDSLWKLAQNYNTSVAAITSANHLSTTVLSIGQTLTIPGSNSGTSSSSSGSTAKKSGNSVYTVKSGDSLWLIANEFKMSVQELKKLNGLSSDMIRAGQKLKVSGKVSSNSSSGTSSSSKSSKSSSSSSASTGTYKVQLGDSLWKIANKVNMSIAELKVLNNLKSDTIYVNQVLKTKSAGSNSSSKNNSSKSNQSASATTKYTVKSGDSLWKIANKYNLTVQQIRNSNNLKSDVLYVGQVLKLTGKSSSSTSTTPSSSNSSSGTTTTTYTVKSGDSLWVIAQKFNVTAQQIREKNNLKNDVLQIGQKLTITGKASSSNSSSGSSGSTISTSAKINKMIAAAKDHLGVPYRWGGTTPAGFDCSGFIYYALNKVTSVSRLTAAGYWNTMKPVSQPAVGDFVFFSTYKAGPSHVGIYLGNGEFINANDSGVVISNMNNSYWKQRYLGAKRYF

SEQ ID NO: 3635 - protein, 481 aa, Salinibacillus sp.
MKKKLAAGLTASAIVSTTLAITPAEAATIKVKSGDSLWKLAQNYNTSVAAITSANHLSTTVLSIGQTLTIPGSNSGTSSSSSGSTAKKSGNSVYTVKSGDSLWLIANEFKMSVQELKKLNGLSSDMIRAGQKLKVSGKVSSNSSSGTSSSSKPSKSSSSSSASTGTYKVQLGDSLWKIANKVNMSIAELKVLNNLKSDTIYVNQVLKTKSAGSNSSSKNNSSKSNQSASATTKYTVKSGDSLWKIANKYNLTVQQIRNSNNLKSDVLYVGQVLKLTGKSSSSTSTTPSSSNSSSGTTTTTYTVKSGDSLWVIAQKFNVTAQQIREKNNLKNDVLQIGQKLTITGKASSSNSSSGSSGSTISTSAKINKMIAAAKEHLGVPYRWGGTTPAGFDCSGFIYYALNKVTSVSRLTAAGYWNTMKSVSQPAVGDFVFFSTYKAGPSHVGIYLGNGEFINANDSGVVISNMNNSYWKQRYLGAKRYF

SEQ ID NO: 3636 - protein, 481 aa, Bacillus sp.
MKKKLAAGLTASAIVSTTLAITPAEAATIKVKSGDSLWKLAQNYNTSVAAITSANHLSTTVLSIGQTLTIPGSNSGTSSSSSGSTAKKSGNSVYTVKSGDSLWLIANEYKMSVQELKKLNGLSSDMIRAGQKLKVSGKVSSNSSSGTSSSSKSSKSSSSSSASTGTYKVQLGDSLWKIANKVNMSIAELKVLNNLKSDTIYVNQVLKTKSAGSNSSSKDNSSKSNQSASATTKYTVKSGDSLWKIANKYNLTVQQIRNSNNLKSDVLYVGQVLKLTGKSTSGTSTTPSSSNSSSGTTTTTYTVKSGDSLWVIAQKFNVTAQQIREKNNLKNDVLQIGQKLTITGKASSSNSSSGSSGSTISTSAKINKMIAAAKEQLGVPYRWGGTTPAGFDCSGFIYYALNKVTSVSRLTAAGYWNTMKSVSQPAVGDFVFFSTYKAGPSHVGIYLGNGEFINANDSGVVISNMNNSYWKQRYLGAKRYF

SEQ ID NO: 3637 - protein, 477 aa, Bacillus sp.
MKKKLAAGLTATAIVSSTLAITPAEAATIKVKSGDSLWKLAQTYNTSVAAISSANHLSTTVLSIGQTLTIPGSKSDTSSSSSGSKKKNGNAVYTVKNGDSLWLIANEYKMSVQELKKLNGLSSDMIRAGQKLKVSGKVSSHSSSGTSSSSKSSSSSSAKTGTYKVQLGDSLWKIANKVNMSIAELKVLNNLKSDTIYVNQVLKTKSAGSHSSSKDNSSKSNQSASATTKYTVKSGDSLWKIANKYNLTVQQIRNSNNLKSDVLYVGQVLKLTGKSSSGTSTSPSSSNSSSGTTTTTYTVKSGDSLWVIAQKFNVTAQQIREKNNLKTDVLQIGQKLTITGKASSPSSSSGSSGSTISTSAKINKMIAAAKEQLGVPYRWGGTTPAGFDCSGFIYYALNKVTSVSRLTAAGYWNTMKSVSQPAVGDFVFFSTYKAGPSHVGIYLGNGEFINANDSGVVISNMNNSYWKQRYLGAKRYF

SEQ ID NO: 3638 - protein, 479 aa, Bacillus sp.
MKKKLAAGLTASAIVSTTLAVAPAEAATIKVKSGDSLWKLAQNYNTSVAAITSANHLSTTVLSIGQTLTIPGSNSSTSSTSSSTTKKSGSSVYTVKSGDSLWLIANEYKMTVQELKKLNGLSSDMIRAGQKLKVSGTVSSSSSSSTSKKSSSNKSSSSSSSTGTYKVKLGDSLWKIANKVNMSVAELKVLNNLKSDTIYVNQVLKTKSSGSNTSSKDTSSNSNQTSATTKYTVKSGDSLWKIANNYNLTVQQIRNSNNLKSDVLYVGQVLKLTGKASSGSSSSSSSSNASSGTTTTTYTVKSGDSLWVIAQKFNVTAQQIREKNNLKTDVLQVGQKLVITGKASSSSSASSGSSSTTSSSSAKINTMIAAAKEQLGVPYRWGGTTPAGFDCSGFIYYALNKVTSVSRLTAAGYWNTMKSVSQPAVGDFVFFTTYKAGPSHVGIYLGNGEFINANDSGVVISSMNNSYWKQRYLGAKRYF

SEQ ID NO: 3639 - protein, 488 aa, Bacillus sp.
MKKKLAAGLTASAIVGTTLVVTPAEAATIKVKSGDSLWKLAQTYNTSVAALTSANHLSTTVLSIGQTLTIPGSKSSTSSSTSSSTTKKSGSSVYTVKSGDSLWLIANEFKMTVQELKKLNGLSSDLIRAGQKLKVSGTVSSSSSSSKKSNSNKSSSSSSKSSSNKSSSSSSSTGTYKVQLGDSLWKIANKVNMSIAELKVLNNLKSDTIYVNQVLKTKSSGSDTSSKDNSSKSNQTSATTKYTVKSGDSLWKIANNYNLTVQQIRNINNLKSDVLYVGQVLKLTGKASSGSSSSSSSSSNASSGTTTTYTVKSGDSLWVIAQKFNVTAQQIREKNNLKTDVLQVGQKLVISGKASSSSSSGSSNTTSSTSAKINTMISAAKAQLGVPYRWGGTTPSGFDCSGFIYYVLNKVTSVSRLTAAGYWNTMKSVSQPAVGDFVFFSTYKAGPSHVGIYLGNGEFINANDSGVVISNMNNSYWKQRYLGAKRYF

SEQ ID NO: 3640 - protein, 488 aa, Bacillus sp.
MKKKLAAGLTASAIVGTTLAVTPAEAATIKVKSGDSLWKLAQTYNTSVAALTSANHLSTTVLSIGQTLTIPGSNSGTSSTSSSTTKKSGSSVYTVKSGDSLWLIANEYKMTVQELKKLNGLSSDLIRAGQKLKVSGTVSSSSSSSTKSNSNKSSSSSSKSSSNKSSSSSSATGTYKVQLGDSLWKIANKVNMSIAELKVLNNLKSDTIYVNQVLKTKSSGSDTSSKDTSSKPNQNSATTKYTVKSGDSLWKIANNYNLTVQQIRNVNNLKSDVLYVGQVLKLTGKASSGTSSSSSSSSNASSGTTTTYTVISGDSLWVIAQKFNVTAQQIREKNNLKTDVLQVGQKLVITGKASSSSSSSGSSNTTISTSAKINTMIAAAKEQIGVPYRWGGTTPSGFDCSGFIYYVLNKVTSVSRLTAAGYWNTMKPVSQPAVGDFVFFTTYKAGPSHVGVYLGNGEFINANDSGVVISNMNNSYWKQRYLGAKRYF

SEQ ID NO: 3641 - protein, 498 aa, Bacillus sp.
MKKKLAAGLTASAIVGTTLVVTPAEAATIKVKSGDSLWKLAQTYNTSVAALTSANHLSTTVLSIGQTLTIPGSKSSTSSSTSSSTTKKSGSSVYTVKSGDSLWLIANEFKMTVQELKKLNGLSSDLIRAGQKLKVSGTVSSSSSTKSSSNKSSSSSSKSSSNKSSSSSSKSSSNKSSSSSSSTGTYKVQLGDSLWKIANKVNMSIAELKVLNNLKSDTIYVNQVLKTKSSGSDTSSKDNSSKSNQTSATTKYTVKSGDSLWKIANNYNLTVQQIRNINNLKSDVLYVGQVLKLTGKASSGSSSSSSSSSNASSGTTTTYTVKSGDSLWVIAQKFNVTAQQIREKNNLKTDVLQVGQKLVISGKASSSSSSGSSNTTSSTSAKINTMISAAKAQLGVPYRWGGTTPSGFDCSGFIYYVLNKVTSVSRLTAAGYWNTMKSVSQPAVGDFVFFTTYKAGPSHVGIYLGNGEFINANDSGVVISNMNNSYWKQRYLGAKRYF

SEQ ID NO: 3642 - protein, 483 aa, Bacillus sp.
MKKKLAAGLTASAIVSTTLAVTPADAATIKVKSGDSLWKLAQTYNTSVAALTSANHLSSTVLSIGQTLTIPGSNSGTSSTSSSTTKKSGSSVYTVKSGDSLWLIANEFKMTVQELKKVNGLSSNMIRAGQKLKVSGTVSSSSSSSPSTSSSKKSSSNKSSSSSSSAGTYKVQLGDSLWKIANKVSMSVAELKVLNNLKSDTIYVNQVLKTKSTGSDTSSKDTQSHSDKPSPTTTYKVKSGDSLWKIANSYNLTVQQIRNSNNLKSDMLYVGQVLKLTGKASSGSSSSSSSSSNASSGTTTTYTVKSGDSLWVIAQKYNVTAQQIREKNNLKTDVLRIGQKLVIAGKALSSGSSSSGSTSTSSSPSAKINKMIAAAKEQLGVPYRWGGTTPNGFDCSGFMYYALNKVTSVSRLTAAGYWNTMKSVSQPAVGDFVFFTTYKAGPSHVGIYLGNGQFINANDSGVVISNMNNSYWKQRYLGAKRYF

SEQ ID NO: 3643 - protein, 425 aa, Bacillus sp.
SANHLSTTVLSIGQTLTIPGSKSDTSSSSSGSKKKNGNAVYTVKNGDSLWLIANEYKMSVQELKKLNGLSSDMIRAGQKLKVSGKVSSHSSSGTSSSSKSSSSSSAKTGTYKVQLGDSLWKIANKVNMSIAELKVLNNLKSDTIYVNQVLKTKSAGSHSSSKDNSSKSNQSASATTKYTVKSGDSLWKIANKYNLTVQQIRNSNNLKSDVLYVGQVLKLTGKSSSGTSTSPSSSNSSSGTTTTTYTVKSGDSLWVIAQKFNVTAQQIREKNNLKTDVLQIGQKLTITGKASSPSSSSGSSGSTISTSAKINKMIAAAKEQLGVPYRWGGTTPAGFDCSGFIYYALNKVTSVSRLTAAGYWNTMKSVSQPAVGDFVFFSTYKAGPSHVGIYLGNGEFINANDSGVVISNMNNSYWKQRYLGAKRYF

SEQ ID NO: 3644 - protein, 469 aa, Bacillus sp.
MKKKLAAGLTASAIVGTTFAVTPAEAQTIKVKSGDSLWKLAQNYNTTIDKIKSANHLKSTVLSIGQTLDIPNGKSSSSTSSSSAKSGKSVYTVKNGDSLWLIASDFKMSVQELKKLNGLSSDLIRAGQKLKVSGTVSNSKSSTNKSSQSNKKTSASGTYTVQLGDSLWKIANKVNMSIGELKVLNNLKSDTIYVKQVLKIKGTASDKTSSNSNSSSKTKPSSSTKYIVKSGDSLWKIANQHNVSVQQIRNSNNLKSDVLQVGQVLQLSGTSSNSSTSPSKNTGSGKTTVYTVKSGDSLWVIAQKYNVTAQQIRDKNNLKTDVLQVGQKLTISGTASTPSTSSPSTSTGSRSTKINQMIAAAKQQLGVPYRWGGTTPSGFDCSGFIYYALNKVTSVSRLTAAGYWNVMKSVSQPAVGDFVFFTTYAAGPSHVGIYLGNGEFINANDSGVVISKMSNSYWKQRYLGAKRYL

SEQ ID NO: 3645 - protein, 485 aa, Bacillus sp.
MKKKVAVGLTASAIVGSALAVTPAEAQTIKVKSGDSLWKLAQNYNTSVDAITSANHLKSTVISIGQTLTIPNGKSDSGSKKPSSKNSGKTTSVYTVKSGDSLWLIASDFKMSVQELKKLNGLTSDLIRAGQKLQVKGKVSSSTDKTKTVPGSSSNSSKNQSSSSSGTYKVKLGDSLWKIANSVHMSIAELKVLNNLKTDTIYVNQVLKIKGTSPSGNKPSKDNSNKNQNQTQTSSYTVKSGDSLWKIANAYNMTVQQIRSINKLTSDMLRVGQVLKLTKTSSSGSSSSPSSPNQSGDTGKTTTYTVKSGDSLWVIAQKFNVTAQQIREKNNLKTDVLQIGQKLTITGQQSNTTPNQSGSTGGTGSTSAKINVMIDAAKAQLGVPYVWGGTTPRGFDCSGFIYYVLNKVTSVSRLSAAGYWNTMTSVSQPAVGDFVFFSTYKAGPSHVGIYLGNGQFINANDSGVVISSMNNSYWKQRYLGAKRFF

SEQ ID NO: 3646 - protein, 484 aa, Bacillus sp.
MKKKVAVGLTASAIVGSALAVTPAEAQTIKVKSGDSLWKLAQNYNTSVDAITSANHLKSTVISIGQTLNIPNGKSDSGSKKPSSKNSGTTKSVYTVKSGDSLWLIASDFKMSVQELKKLNGLTSDLIRAGQKLQVTGKVSSSTDQKKTAPGSSSNNSKKQSSSSGTYKVKLGDSLWKIANSVNMTIAELKVLNNLKTDTIYVNQVLKTKGTSSSGNTPSKDNSNQNKNQTQTSSYTVKSGDSLWKIANAYNMTVQQIRSINKLTSDMLRVGQVLKLTKTSSSGSSSSPSTPNQSGDTGKTTTYTVKSGDSLWVIAQKFNVTAQQIREKNNLKTDVLQIGQKLTITGQQTNTTPNQSGNTGGTGSTSAKINVMIDAAKAQLGVPYVWGGTTPRGFDCSGFIYYVLNKVTSVSRLSAAGYWNTMTSVSQPAVGDFVFFSTYKAGPSHVGIYLGNGQFINANDSGVVISSMNNSYWKQRYLGAKRFF

SEQ ID NO: 3647 - protein, 642 aa, Salinibacillus sp.
MKPVISLILSTVLFLSCFLGVSQTAEAKPRSSDDAKQIVDRMTLDEKIGQMLMPDFRNWKKEGESSPQAFTKMNEEVAGLIKKYQFGGVILFAENVKTTEQTVRLTDAYQKASPKIPLLLSIDQEGGIVTRLGEGTNFPGNMALGATRSRINAYQTGSMIGKELSVLGINTDFSPVLDINNNPDNPVIGVRSFSSDRELTARLGLYSMKGLQRQNIASALKHFPGHGDTDVDSHYGLPLVSHNQERLREVELYPFQKAIDAGADMVMTAHVQFPAFDDTTYKSKFDGSDIMVPATLSKKVMTGLLREEMGFGGVIVTDALNMKAIADHFGQEEAVVMAIKAGVDIALMPASVTSLKDEQKLASVIDSLKEAVKNGDIPLQQINKSVERIISLKIKRGIYPAHYDSSIDKKVKKALKTVGSKHHTKTEQKIAEKAVTVLKNDQHTLPFKPKKGSRILIAAPYEEQTASIEKTIHDLMQRKKIKSVSLNKMNFAEKVFNAEHEKQVKEADYIITGSYVVKNDPVVNDGVIDDTVTDSSKWATAFPRAVMNAALQHKKQFVLMSLRNPYDAANFEEARALIAVYGFKGYANGRYLQPNIPAGVKAIFGQSKPKGTLPVDIPSVTKPGDILYPFGYGVNIKTGKPL

SEQ ID NO: 3648 - protein, 642 aa, Bacillus sp.
MKPVISLILSTVLFLSCFLGVSQTAEAKPRSSDDAKQIVDRMTLDEKLGQMLMPDFRNWKKEGESSPQAFTKMNEEVAGLIKKYQFGGVILFAENVKTTEQTVRLTDAYQKASPKIPLLLSIDQEGGIVTRLGEGTNFPGNMALGATRSRINAYQTGSMIGKELSVLGINTDFSPVLDINNNPDNPVIGVRSFSSDRELTARLGLYSMKGLQRQHIASALKHFPGHGDTDVDSHYGLPLVSHNQERLREVELYPFQKAIDAGADMVMTAHVQFPAFDDTTYKSKLDGSDIMVPATLSKKVMTGLLREEMGFGGVIVTDALNMKAIADHFGQEEAVVMAIKAGVDIALMPASVTSLKDEQKLASVINSLKEAVKNGDIPLQQINKSVERIISLKIKRGIYPAQHDSNIDKKVKKALKTVGSKHHTKTEQKIAEKAVTVLKNDQHTLPFKPKKGSRILIAAPYEEQTASIEKTIHDLVERKKIKSVSLNKINFAEKVFNAEHEKQVKEADYIITGSYVVKNDPVVNDGVIDDTVTDSSKWATAFPRAVMNAALQHKKQFVLMSLRNPYDAANFEEASALIAVYGFKGYANGRYLQPNIPAGVKAIFGQSKPKGTLPVDIPSVTKPGDILYPFGYGVNIKMGKPL

SEQ ID NO: 3649 - protein, 642 aa, Bacillus sp.
MKPVISLILSTVLFLSCVLGVNQTAKAKPRGSADAKQIVDHMTLDEKLGQMLMPDFRNWQKEGESSPKAFTEMNEEVAGLIKKYQFGGVILFAENVKTTEQTVRLTDAYQKAGPKIPLLLSIDQEGGIVTRLGEGTHFPGNMALGATRSRINAYQTGSMIGKELSVLGINTDFSPVLDINNNPDNPVIGVRSFSSDRELTARLGLYSMKGLQRQHIASALKHFPGHGDTDVDSHYGLPLVSHSQERLREVELYPFQKAIDAGADMVMTAHVQFPAFDDTTYKSKLDGSDIMVPATLSKKVMTGLLREEMGFGGVIVTDALNMKAIADHFGQEEAVVMAIKAGVDIALMPASVTSLKNEHKFASIIGSLKEAVEKGDIPLQQINKSVERIISLKIKRGIYPAQNDSSIDKKVKKALKTVGSKHHTKTEQKIAEKAVTVLKNDQHTLPFKPKKGSRILIAAPYEEQSASIEKTIHDLMQRKKINSVSLNKINFAEKVFNAEYEKQVKEADYIITGSYVVKNDPVVNDGVIDDTVTDSSKWATAFPRAVMNAALQHKKQFVLMSLRNPYDAANFEEARALIAVYGFKGYANGRYLQPNIPAGVKAIFGQSKPKGTLPVDIPSVTKPGDILYPYGYGVNIKTGKPL

SEQ ID NO: 3650 - protein, 642 aa, Bacillus sp.
MKPVFPLILSAVLFFSCFLGASQTKAASSSGSADAKQIVNRMTLDEKLGQMLMPDFRNWQKEGESSPQAFTEMNEEVAGLIKKYQFGGVILFAENVKTTQQTVQLTDAYQKASPKIPLMLSIDQEGGIVTRLGEGTNFPGNMALGAARSRINAYQTGTIIGKELSALGINTDFSPVMDINNNPDNPVIGVRSFSSNRELTARLGLYTMKGLQRQDIASALKHFPGHGDTDVDSHYGLPLVSHSQERLREVELYPFQRAIDAGADMVMTAHVQFPAFDDTTYKSKLDGSDILVPATLSKKVMTGLLRQEMGFNGVIVTDALNMKAIADHFGQEEAVVMAIKAGVDIALMPASVTSLKEEQKYARVIQALEEAVKNGDIPEHQINKSVERIISLKIKRGMYPARNDDSIKEKIDKAQKIVGSKHHLKAEKKIAEKAVTVLKNEQHTLPFKPKKDSRILIVAPYEEQTASIEQTIRDLVKRKKIKPVSLSKMNFANQVFNAEHEKQVKEADYIITGSYVVKNDPVVNDGVIDDTISDSSKWATVFPRAVMKATLQHNKPFVLMSLRNPYDAANFEEAKALIAVYGFKGYANGRYLQPNIPAGVMAIFGQVKPKGTLPVDIPSVTKPGDILYPYGYGLNIKTGKPL

SEQ ID NO: 3651 - protein, 642 aa, Bacillus sp.
MKPVFPLILSAVLFLSCFLGTSQTKAASSSNSIDTKQLVNRMTLDEKLGQMLMPDFRNWQKKSESSPQAFTEMNEEVAGLIKKYQFGGVILFAENVKTTKQTVQLTDAYQKASPKIPLILSIDQEGGIVTRLGEGTNFPGNMALGAARSRINAYQTGTIIGKELSALGINTDFSPVVDINNNPDNPVIGVRSFSSNRELTARLGLYTMKGLQRQDIASALKHFPGHGDTDVDSHYGLPLVSHSQERLREVELYPFQRAIDAGADMVMTAHVQFPAFDDTTYKSKLDGSDILVPATLSKKVMTGLLRQEMGFNGVIVTDALNMKAIADHFGQEEAVVMAVKAGVDIALMPASVTSLKEEQKFARVIQALKEAVKNGDIPEHQINKSVERIISLKIKRGIYPARSGDSIKEKIAKAQKIAGSKRHLKAEKKIAEKAVTVLKNEQHTLPFKPKKDSRILIVAPYEEQTASIEQTIRDLIKRKKIKSVSLSKVNFANQVFNAEHEKLVKEADYIITGSYVVKNDPAVNDGVIDDTISDSSKWATVFPRAVMKAALQHNKPFVLMSLRNPYDAANFEEAKALIAVYGFKGYANGRYLQPNIPAGVRAIFGQAKPKGTLPVDIPSVTKPGDILYPYGYGLNIKTGKPL

SEQ ID NO: 3652 - protein, 642 aa, Bacillus sp.
MKPVFPLILSAVLFLSCFLVANQKEATASKSSIDANQIVNRMSLDEKLGQMLMPDFRNWQKKGESSPQALTEMNEEVASLVKKYQFGGVILFAENVKTTKQTVQLTDAYQKASPKIPLMLSIDQEGGIVTRLGEGTNFPGNMALGAARSRINAYQTGSIIGKELSALGINTDFSPVVDINNNPDNPVIGVRSFSSNRELTSRLGLYTMKGLQRQDIASALKHFPGHGDTDVDSHYGLPLVSHDQERLREVELYPFQKAIDAGADMVMTAHVQFPAFDDTTYKSKLDGSDILVPATLSKKVMTGLLRQEMGFNGVIVTDALNMKAIADHFGQEEAVVMAVKAGVDIALMPASVTSLKEEQKFARVIQALKEAVKNGDIPEHQINKSVERIISLKIKRGMYPARNDDSTKEKIAKAQKIVGSKQHLKAEKKIAEKAVTVLKNEQHTLPFKPKKGSRILIVAPYEEQTASIEQTIRDLVNRKKIKPVSVDKMNFANQVFKAEHEKQVKEADYIITGSYVVKNDPVVNDGVIDDTISDSSKWATVFPRAVMKAALQHNKPFVLMSLRNPYDAANFEEAKALIAVYGFKGYTNGRYLQPNIPAGVMAIFGQTKPKGTLPVDIPSVTKPGNTLYPFGYGLNIKTGNPL

SEQ ID NO: 3653 - protein, 642 aa, Bacillus sp.
MRPVFPLILSAVLFLSCFFGARQTEASASKRSIDANQIVNRMSLDEKLGQMLMPDFRNWQKEGESSPQALTEMNDEVASLVKKYQFGGIILFAENVKTTKQTVQLTDDYQKASPKIPLMLSIDQEGGIVTRLGEGTNFPGNMALGAARSRINAYQTGSIIGKELSALGINTDFSPVVDINNNPDNPVIGVRSFSSNRELTSRLGLYTMKGLQRQDIASALKHFPGHGDTDVDSHYGLPLVSHGQERLREVELYPFQKAIDAGADMVMTAHVQFPAFDDTTYKSKLDGSDILVPATLSQKVMTGLLRQEMGFNGVIVTDALNMKAIADHFGQEEAVVMAVKAGVDIALMPASVTSMKEEQKFARVIQALKEAVKNGDIPEQQINKSVERIISLKIKRGMYPARNSDSTKEKIAKAKKIVGSQQHLKAEKKIAEKAVTVLKNEQHTLPFKPKKGSRILIVAPYEEQTASIEQTIHDLIKRKKIKPVSLSKMNFANQVFKAEHAKQVKKADYIITGSYVVKNDPVVNDGVIDDTISDSSKWATVFPRAVMKAALQHNKPFVLMSLRNPYDAANFEEAKALIAVYGFKGYANGRYLQPNIPAGVMAIFGQAKPKGTLPVNIPSVTKPGNTLYPFGYGLNIKTGRPL

SEQ ID NO: 3654 - protein, 642 aa, Bacillus sp.
MRPVFPLILSAVLFLSCFFGARQTEASASKRAIDANQIVNRMSLDEKLGQMLMPDFRNWQKEGESSPQALTEMNDEVASLVKKYQFGGIILFAENVKTTKQTVQLTDDYQKASPKIPLMLSIDQEGGIVTRLGEGTNFPGNMALGAARSRINAYQTGSIIGKELSALGINTDFSPVVDINNNPDNPVIGVRSFSSNRELTSRLGLYTMKGLQRQDIASALKHFPGHGDTDVDSHYGLPLVSHGQERLREVELYPFQKAIDAGADMVMTAHVQFPAFDDTTYKSKLDGSDILVPATLSQKVMTGLLRQEMGFNGVIVTDALNMKAIADHFGQEEAVVMAVKAGVDIALMPASVTSMKEEQKFARVIQALKEAVKNGDIPEQQINKSVERIISLKIKRGMYPARNSDSTKEKIAKAKKIVGSQQHLKTEKKIAEKAVTVLKNEQHTLPFKPKKGSRILIVAPYEEQTASIEQTIHDLIKRKKIKPVSVDKMNFANQVFNAEHAKQVKKADYIITGSYVVKNDPVVNDGVIDDTISDSSKWATVFPRAVMKAALQHNKPFVLMSLRNPYDAANFEEAKALIAVYGFKGYANGRYLQPNIPAGVMAIFGQAKPKGTLPVNIPSVTNPGDTLYPYGYGLNIKTGRPL

SEQ ID NO: 3655 - protein, 642 aa, Bacillus sp.
MRPVFPLILSAVLFLSCFFGARQTEASASKRAIDANQIVNRMSLDEKLGQMLMPDFRNWQKEGESSPQALTEMNDEVASLVKKYQFGGIILFAENVKTTKQTVQLTDDYQKASPKIPLMLSIDQEGGIVTRLGEGTNFPGNMALGAARSRINAYQTGSIIGKELSALGINTDFSPVVDINNNPNNPVIGVRSFSSNRELTSRLGLYTMKGLQRQDIASALKHFPGHGDTDVDSHYGLPLVSHGQERLREVELYPFQKAIDAGADMVMTAHVQFPAFDDTTYKSKLDGSDILVPATLSKKVMTGLLRQEMGFNGVIVTDALNMKAIADHFGQEEAVVMAVRAGVDIALMPASVTSLKEEQKFARVIQALKEAVKNGDIPEQQINNSVERIISLKIKRGMYPARNSDSTKEKIAKAKKIVGSKQHLKAEKKIAEKAVTVLKNEQHTLPFKPKKGSRILIVAPYEEQTASIEQTIHDLIKRKKIKPVSVDKMNFANQVFKAEHAKQVKKADYIITGSYVVKNDPVVNDGVIDDTISDSSKWATVFPRAVMKAALQHNKPFVLMSLRNPYDAANFEETKALIAVYGFKGYANGRYLQPNIPAGVMAIFGQAKPKGTLPVDIPSVTKPGNTLYPFGYGLNIKTGRPL

SEQ ID NO: 3656 - protein, 642 aa, Bacillus sp.
MRPVFPLILSAVLFLSCFFGARQTEASASKRAIDANQIVNRMSLDEKLGQMLMPDFRNWQKEGESSPQALTEMNDEVASLVKKYQFGGIILFAENVKTTKQTVQLTDDYQKASPKIPLMLSIDQEGGIVTRLGEGTNFPGNMALGAARSRINAYQTGSIIGKELSALGINTDFSPVVDINNNPNNPVIGVRSFSSNRELTSRLGLYTMKGLQRQDIASALKHFPGHGDTDVDSHYGLPLVSHGQERLREVELYPFQKAIDAGADMVMTAHVQFPAFDDTTYKSKLDGSDILVPATLSQKVMTGLLRQEMGFNGVIVTDALNMKAIADHFGQEEAVVMAVKAGVDIALMPASVTSMKEEQKFARVIQALKEAVKNGDIPEQQINKSVERIISLKIKRGMYPARNSDSTKEKIANAKKIVGSKRHLKAEKKIAEKAVTVLKNEQHTLPFKPKKGSHILIVAPYEEQTASIEQTIHDLIKRKKIKPVSVDKMNFANQIFNAEHAKQVKKADYIITGSYVVKNDPVVNDGVIDDTISDSSKWATVFPRAVMKAALQHNKPFVLMSLRNPYDAANFEEAKALIAVYGFKGYANGRYLQPNIPAGVMAIFGQAKPKGTLPVDIPSVTKPGNTLYPFGYGLNIKTGRPL

SEQ ID NO: 3657 - protein, 642 aa, Bacillus sp.
MKSIISITLSTVLCLSACLVASPASAAKPSKATTAKQLTAQMTLDEKLGQMLMPDFRNWQKEGAASPSALTEMNDEVAGLVEKYQFGGVILFAENVKTTEQTVRLTDAFQKASPNIPLLLSIDQEGGIVTRLGEGTNFPGNMALGAARSSNYAYLTGTVIGKELSALGINTNFGPVLDINNNPNNPVIGVRSFSSNREVTAKLGMYSMKGLQKQNVASAVKHFPGHGDTDVDSHYGLPLVSHNKERLREVELYPFQKAINAGADMVMTAHVQFPAFDDTTYKSKLDGSDILVPATLSRKVMTGLLREEMGFDGVIVTDALNMKAIADHFGQEEAVVMAVKAGVDIALMPAAVTSLKTENRFDSVLQALKKAVTQGDIPLQQINQSVERIISLKIKRGIYPAQNKGSIDKKVAKALKTVGRKQHRKAEKQIAEKAVTILKNEQHTLPFKPKKGSSILIAAPYEEQTEAIAQTITDLVQRKKIKPVSLSKLNFEGRVFDAETEKQIKEADYVITGSYVVKNDPVINDGVIDDTVTDSSKWATVFPRAVMKSAQQNHKKFVLMSLRNPYDAANFEEAQALIAVYGFKGYAEGRYLQPNIPAGIEAIFGQTKPKGTLPVDIPSVTRPGDILYPYGHGVNLKTGKPL

SEQ ID NO: 3658 - protein, 642 aa, Bacillus sp.
MKSIISITLSTVLCLSACLVASPASAAKPSGATTTKQLTAQMTLDEKLGQMLMPDFRNWQKEGAASPAALTEMNDEVAGLVEKYQFGGVILFAENVKTTEQTVRLTDAFQKASPNIPLLLSIDQEGGIVTRLGEGTNFPGNMALGAARSSNYAYLTGTVIGKELSALGINTDFGPVLDINNNPNNPVIGVRSFSSNREVTAKLGMYSMKGLQKQNVASAVKHFPGHGDTDVDSHYGLPLVSHNKERLREVELYPFQKAINAGADMVMTAHVQFPAFDDTTYKSKLDGSDILVPATLSRKVMTGLLREEMGFDGVIVTDALNMKAIADHFGQEEAVVMAVKAGVDIALMPAAVTSLKTENRFDSVLQALKKAVTQGDIPLQQINQSVERIISLKIKRGIYPAQNKGSIDKKVAKALKTVGRKQHRKAEKQIAEKAVTILKNEQHTLPFKPKKGSSILIAAPYKEQTEAIAQTITDLVQRKKIKPVSLSKLNFEGRVFDAETEKQIKEADYVITGSYVVKNDPVINDGVIDDTVTDSSKWATVFPRAVMKSAQQNHKKFVLMSLRNPYDAANFEEAQALIAVYGFKGYADGRYLQPNIPAGIEAIFGQTKPKGTLPVDIPSVTRPGDILYPYGHGVNLKTGKPL

SEQ ID NO: 3659 - protein, 637 aa, Bacillus sp.
MKLLISAVLLLFIVFGTHHASTKPDIPSQAEQAVSRMTLDEKLGQMLMPDFRNWQKKGQSSPKALTQMNDEVAGLIQKYRFGGVILFAENVKDTEQTVRLTDAFQKASPDIPLLLSIDQEGGIVTRLGEGTHFPGNMALGAARKTAYASQTGAIIGKELKALGINTNFAPVLDINNNPGNPVIGVRSFSSDRDLTASLGLASMKAQQKQNVAAAVKHFPGHGDTDVDSHYGLPLVTHNQERLRQIELYPFRQAIQGGADMIMTAHVQFPAFDDTTYKSKLDGSDILVPATLSKKVMTHLLRDEMGFNGVIVTDALNMKAIADHFGQEEAVVMAVKAGVDIALMPAQVTSLQTENRFARVHSALKKAVQKGDIPLQQINKSAERIISLKIKRGIYPAPKETNLKKKIAKAKKTVGSKNHLKAEKQIAERSVTVLQNKNRTLPFKPKKNSRVLIAAPYEDQTAAMEQTIRQLIKKKKIRPVTISKMNFAERTFHDEHKKLVSDADYVITGSYVVKNDPVVNDGVIDDSVTDPGKWTTAFPRAVMKAAQSNQKPFVLMSLRNPYDAANFEEAEALIAVYGFKGYTDGQFLQPNIPAGIEAIFGQTTPQGRLPADIPSVTHPGTTLYPYGFGINLKTGKPL

SEQ ID NO: 3660 - protein, 637 aa, Bacillus sp.
MKLVISAVLMLFIVFGTHHASTKPDIPSQAEQAVSRMTLDEKLGQMLMPDFRNWQKKGQPSPEALTQMNDEVAGLIQKYRFGGVILFAENVKNTEQTVRLTDAFQKASPDIPLLLSIDQEGGIVTRLGEGTHFPGNMALGAARKTAYASQTGAIIGKELKALGINTNFAPVLDINNNPGNPVIGVRSFSSDRDLTASLGLASMKAQQKQDVAAAVKHFPGHGDTDVDSHYGLPLVTHNQERLRQIELYPFRKAIQAGADMIMTAHVQFPAFDDTTYKSKLDGSDILVPATLSKKVMTHLLREEMGFNGVIVTDALNMKAIADHFGQEEAVVMAVKAGVDIALMPAQVTSLQTENRFARVHSALKKAVQKGEIPLQQINKSVKRIISLKIKRGIYPAPKETNLKKKIAKAKKTVGSKNHLKAEKQIAARSVTVLQNKNRTLPFKPKKNSRVLITAPYEDQTASMEQTIRQLIKKKKIRPVTISKMNFAERTFHDEHKKLVSDADYVITGSYVVKNDPVVNDGVIDDSVTDPGKWTTAFPRAVMKAAQSNQKPFVLMSLRNPYDAANFEEAEALIAVYGFKGYTDGQFLQPNIPAGIEAIFGQTTPQGRLPADIPSVTHPGTALYPYGFGINLKTGKPL

SEQ ID NO: 3661 - protein, 362 aa, Salinibacillus sp.
MLKKPIICLFILFLFASAVLSEPIQAHTVLPVNPKAQQTTRDVMNWLAHLPNRSENRVLSGAFGGYSHDTFSMAEAERIRNSAGQSPAIYGCDYARGWLETSNIEDSIDVSCNSDLISYWKSGGIPQISLHLANPAYQSGHYKTPITNDQYKKLLDSSTTEGKRLNAMLSKIADGLQELENQGVPVLFRPLHEMNGEWFWWGLTSYNQKDDERIYLYKQLYIKIYHYMTEERGLDHLLWVFSPDANRDFKTDFYPGASYVDIVGLDAYFQDPYSISGYDQLTALNKPFAFTEVGPQTANGSFDYSLFMSAIKQKYPKTTYFLAWNDEWSPAVNKGASSLYNDNWTLNKGEVWNGNTLTPIVE

SEQ ID NO: 3662 - protein, 362 aa, Bacillus sp.
MLKKPIICLFILFLFAPAVLAEPIQAHTVSPVNPKAQQTTKDLMNWLAHLPNRSENRVLSGAFGGYSHDTFSMAEAERIRSSAGQSPAIYGCDYARGWLETSNIEDSIDVSCNSDLISYWKSGGIPQISLHLANPAYQSGHYKTPITNDQYKKLLDSSTTEGKRLNAMLSKIADGLQELEKQGVPVLFRPLHEMNGEWFWWGLTSYNQKDDERIYLYKQLYIKIYHYMTDERGLDHLLWVYSPDANRDFKTDFYPGASYVDIVGLDAYFQDPYSISGYDQLTALNKPFAFTEVGPQTANGSFDYSLFMSAIKQKYPKTTYFLAWNDEWSPAVNRGASALYNDSWTLNKGEVWNGDTLTPIVE

SEQ ID NO: 3663 - protein, 362 aa, Bacillus sp.
MLKKPIICLFILFLFASAVLAEPIQAHTVSPVNPKAQQTTKDVMNWLAHLPNRSENRVLSGAFGGYSHDTFSMAEAERIRNASGQSPAIYGCDYARGWLETSNIEDSIDVSCNSDLISYWKSGGIPQISLHLANPAYQSGHFKTPITNDQYKKLLDSTTTEGKRLNAMLSKIADGLQQLENQGVPVLFRPLHEMNGEWFWWGLTSYNQKDDERIFLYKQLYIKIYHYMTDERGLDHLLWVYSPDANRDFKTNFYPGASYVDIVGLDAYFQDPYSISGYDQLTALNKPFAFTEVGPQTATGSFDYSLFMSAIKQKYPKTTYYLAWNDEWSPAVNKGASALYNDSWTLNKGEVWNGDTLTPIVE

SEQ ID NO: 3664 - protein, 362 aa, Bacillus sp.
MVKKYTISLLILFLLASAVLAKPIQAHTVSPVNPNAQQTTKAVMNWLAHLPNRTENRVLSGAFGGYSHDTFSMAEADRIRSAAGQSPAIYGCDYARGWLETANIEDSIDVSCNSDLISYWKNGGIPQISLHLANPAFQSGHFKTPITNDQYKKILDSSTVEGKRLNAMLSKIADGLQELKNQGVPVLFRPLHEMNGEWFWWGLTSYNQKDNERISLYKQLYKKIYHYMTDTRGLDHLLWVYSPDANRDFKTDFYPGASYVDIVGLDAYFQDAYSINGYDQLTALNKPFAFTEVGPQTANGSFDYSLFINAIKQKYPKTIYFLAWNDEWSPAVNKGASALYHDSWTLNKGEIWNGDSLTPIVE

SEQ ID NO: 3665 - protein, 362 aa, Bacillus sp.
MFKKHTISLLILFLLASAVLAKPIEAHTVSPVNPNAQQTTKAVMNWLAHLPNRTENRVLSGAFGGYSHDTFSMAEADRIRSATGQSPAIYGCDYARGWLETANIEDSIDVSCNSDLISYWKNGGIPQISMHLANPAFQSGHFKTPITNDQYKKILDSSTAEGKRLNAMLSKIADGLQELENQGVPVLFRPLHEMNGEWFWWGLTSYNQKDNERISLYKQLYKKIYHYMTDTRGLDHLLWVYSPDANRDFKTDFYPGASYVDIVGLDAYFQDAYSINGYDQLTALNKPIAFTEVGPQTANGSFDYSLFINAIKQRYPKTIYFLAWNDEWSPAVNKGASVLYHDSWTLNKGEIWNGDSLTPIVE

SEQ ID NO: 3666 - protein, 362 aa, Bacillus sp.
MFKKHTISLLIIFLLASAVLAKPIEAHTVAPVNPNAQQTTKAVMNWLAHLPNRTENRVLSGAFGGYSHDTFSMAEADRIRSATGQSPAIYGCDYARGWLETAKIEDSIDVSCNGDLISYWKNGGIPQISLHLANPAFQSGHFKTPITNDQYKKILDSSTAEGKRLNAMLSKIADGLQELENQGVPVLFRPLHEMNGEWFWWGLTSYNQKDNERISLYKQLYKKIYHYMTDTRGLDHLIWVYSPDANRDFKTDFYPGASYVDIVGLDAYFQDAYSINGYDQLTALNKPFAFTEVGPQTANGSFDYSLFINAIKQKYPKTIYFLAWNDEWSPAVNKGASALYHDSWTLNKGEIWSGDSLTPIVE

SEQ ID NO: 3667 - protein, 367 aa, Bacillus sp.
MGELHLFKKHTISLLIIFLLASAVLAKPIEAHTVSPVNPNAQQTTKTVMNWLAHLPNRTENRVLSGAFGGYSHDTFSMAEADRIRSATGQSPAIYGCDYARGWLETANIEDSIDVSCNGDLMSYWKNGGIPQISLHLANPAFQSGHFKTPITNDQYKKILDSSTVEGKRLNAMLSKIADGLQELENQGVPVLFRPLHEMNGEWFWWGLTSYNQKDNERISLYKQLYKKIYHYMTDTRGLDHLIWVYSPDANRDFKTDFYPGASYVDIVGLDAYFQDAYSINGYDQLTALNKPFAFTEVGPQTANGSFDYSLFINAIKQKYPKTIYFLAWNDEWSPAVNKGASALYHDSWTLNKGEIWNGDSLTPIVE

SEQ ID NO: 3668 - protein, 367 aa, Bacillus sp.
MGELHLFKKHTISLLIIFLLASAVLAKPIEAHTVSPVNPNAQQTTKAVMNWLAHLPNRTENRVLSGAFGGYSHDTFSMAEADRIRSATGQSPAIYGCDYARGWLETAKIEDSIDVSCNGDLMSYWKNGGIPQISLHLANPAFQSGHFKTPITNDQYKKILDSSTAEGKRLNAMLSKIADGLQELENQGVPVLFRPLHEMNGEWFWWGLTSYNQKDNERISLYKQLYKKIYHYMTDTRGLDHLIWVYSPDANRDFKTDFYPGASYVDIVGLDAYFQDAYSINGYDQLTALNKPFAFTEVGPQTANGSFDYSLFINAVKQKYPKTIYFLAWNDEWSPAVNKGASALYHDSWTLNKGEIWNGDSLTPIVE

SEQ ID NO: 3669 - protein, 368 aa, Bacillus sp.
MNGELHLFKKHTISLLIIFLLTSAVLAKPIEAHTVSPVNPNAQQTTKAVMNWLAHLPNRTENRVLSGAFGGYSHDTFSMAETDRIRSATGQSPAIYGCDYARGWLETANIEDSIDVSCNSDLMSYWKNGGIPQISLHLANPAFQSGHFKTPITNDQYKKILDSSTAEGKRLNAMLSKIADGLQELENQGVPVLFRPLHEMNGEWFWWGLTSYNQKDNERISLYKQLYKKIYHYMTDTRGLDHLIWVYSPDANRDFKTDFYPGASYVDIVGLDAYFQDAYSINGYDQLTALNKPFAFTEVGPQTANGSFDYSLFINAIKQRYPKTIYFLAWNDEWSPAVNKGASALYHDSWTLNKGEIWNGDSLTPIVE

SEQ ID NO: 3670 - protein, 338 aa, Bacillus sp.
MFKKHTISLLILFLLASAVLAKPIEAHTVSPVNPNAQQTTKAVMNWLAHLPNRTENRVLSGAFGGYSHDTFSMAEADRIRSATGQSPAIYGCDYARGWLETAKIEDSIDVSCNGDLISYWKNGGIPQISLHLANPAFQSGHFKTPITNDQYKKILDSSTAEGKRLNAMLSKIADGLQELENQGVPVLFRPLHEMNGEWFWWGLTSYNQKDNERISLYKQLYKKIYHYMTDTRGLDHLIWVYSPDANRDFKTDFYPGASYVDIVGLDAYFQDAYSINGYDQLTALNKPFAFTEVGPQTANGSFDYSLFINAIKQKYPKTIYFLAWNDEWSPAVNKGASA

SEQ ID NO: 3671 - protein, 334 aa, Bacillus sp.
MSPVNPNAQQTTKTVMNWLAHLPNRTENRVLSGAFGGYSHDTFSMAEADRIRSATGQSPAIYGCDYARGWLETANIEDSIDVSCNSDLMSYWKNGGIPQISLHLANPAFQSGHFKTPITNDQYKKILDSSTAEGKRLNAMLSKIADGLQELENQGVPVLFRPLHEMNGEWFWWGLTSYNQKDNERISLYKQLYKKIYHYMTDTRGLDHLIWVYSPDANRDFKTDFYPGESYVDIVGLDAYFQDAYSINGYDQLTALNKPFAFTEVGPQTANSSFDYSLFINAIKQRYPKTIYFLAWNDEWSPAVNKGASALYHDSWTLNKGEIWNGDSLTPIVE

SEQ ID NO: 3672 - protein, 360 aa, Bacillus sp.
MKKNIVCSIFALLLAFAVSQPSYAHTVSPVNPNAQPTTKAVMNWLAHLPNRTESRVMSGAFGGYSLDTFSTAEADRIKQATGQLPAIYGCDYARGWLEPEKIADTIDYSCNRDLIAYWKSGGIPQISMHLANPAFTSGHYKTQISNSQYERILDSSTPEGKRLEAMLSKIADGLQELENEGVPVLFRPLHEMNGEWFWWGLTQYNQKDSERISLYKQLYVKIYDYMTKTRGLDHLLWVYAPDANRDFKTDFYPGASYVDIVGLDAYFDDPYDIDGYEKLTSLNKPFAFTEVGPQTTNGGLDYARFIHAIKEKYPKTTFFLAWNDEWSPAVNKGADTLYLHSWTLNKGEIWDGDSLTPVVE

SEQ ID NO: 3673 - protein, 361 aa, Bacillus sp.
MMKRHIISFVIASLFILAASPAASAHTVSPVNPNAQPTTKATMNWLAHLPNRSENRVMSGAFGGYSLDTFSMAEANQLKNTTGQLPAIYGCDYARGWLEPADITDTVDHSCNSDLISYWKSGGIPQISMHLANPAFTSGHYKTQISNSQYQHILDSSTAEGKRLDAMLEKIADGLEELKNEGVPVLFRPLHEMNGEWFWWGLTEYNQKDSERIALYKQLYQKIYHYMTNERGLDNLIWVYAPDANRDFKADFYPGSSYVDIVGLDAYFADADSIQGYEELTSLDKPFAFTEVGPQETNGSFDYASFINAIRQKYPKTVYFLAWNDGWSPAANKGASSLYNNSWTLNKGEVWDGDSLTPVVE

SEQ ID NO: 3674 - protein, 364 aa, Bacillus sp.
MFKKTGIFILLSFIIISAFSQTASAHTVNPVNPNAQMTTKELTNWLAHLPNRTENRILSGAFGGYTNATFSMTEANRIKNAIGQSPAVYACDYSRGWLESGNITDAIDYSCNSDLISYWKSGGIPQISMHLPNPAFQSGHYKTQISNSQYQKILDSSTTEGKRLDAILSKIADGLQQLKNEGVPVLFRPLHEMNGEWFWWGLTEYNKKDSQRISLYKQLYQKIYHYMTDTRGLDNLIWVYAPDANRDFKTDFYPGSSYVDIVGLDAYFSDPYSIKGYDELTALNKPFAFTEVGPSTTNGIVDSLDYSQFINAIKQKYPKTIYFLAWDDEWSPVANKGASSLYNDSWTLNKGEVWQGSSLTPIVE

SEQ ID NO: 3675 - protein, 360 aa, Bacillus sp.
MLKKFAVCLSIILLLISAARPISAHTVYPVNPNAQQTTKDVMNWLAHLPNRSENRVMSGAFGGYSDVTFSMTEENRLKNATGQSPAIYGCDYGRGWLETSDITDSIDYSCNSSLISYWKSGGLPQVSLHLANPAFPSGHYKTAISNSQYKNILNPSTVEGRRLEALLSKIADGLTQLKNQGVTVLFRPLHEMNGEWFWWGLTGYNQKDTERISLYKELYKKIYRYMTETRGLDNLLWVYSPDANRDFKTDFYPGSSYVDITGLDAYFTDPYAISGYDEMLSLKKPFAFAETGPSGNIGSFDYAVFINAIRQKYPETTYFLTWDEQLSPAANQGAQSLYQNSWTLNKGEMWNGGTLTPIAE

SEQ ID NO: 3676 - protein, 360 aa, Bacillus sp.
MLKKLAVCLSIVLLLLGAASPISAHTVYPVNPNAQQTTKDIMNWLAHLPNRSENRVMSGAFGGYSDVTFSMTEENRLKNATGQSPAIYGCDYGRGWLETADITDSIDYSCNSSLISYWKSGGLPQVSLHLANPAFPSGNYKTAISNSQYKNILDPSTVEGKRLEALLSKIADGLTQLKNQGVTVLFRPLHEMNGEWFWWGLTGYNQKDNERISLYKELYKKIYRYMTETRGLDNLLWVYSPDANRDFKTDFYPGSSYVDITGLDAYFTDPYAISGYDEMLSLKKPFAFAETGPSGNIGSFDYAAFINAIRQKYPETTYFLTWDEQLSPAANQGAQSLYQNSWTLNKGEIWNGGSLTPIAE

SEQ ID NO: 3677 - protein, 360 aa, Bacillus sp.
MLKKLAVCLSIVLLLLGAASPISAHTVYPVNPNAQQTTTDIMNWLAHLPNRSENRVMSGAFGGYSDVTFSMTEENRLKNATGQSPAIYGCDYGRGWLETADITDTIDYSCNSSLISYWKSGGLPQVSLHLANPAFPSGNYKTAISNSQYKNILDPSTVEGKRLEALLSKIADGLTQLKNQGVTVLFRPLHEMNGEWFWWGLTGYNQKDNERISLYKELYKKIYRYMTETRGLDNLLWVYSPDANRDFKTDFYPGSSYVDITGLDAYFTDPYAIAGYDEMLSLKKPFAFAETGPSGNIGSFDYDAFINAIRQKYPETTYFLTWDEQLSPAANQGAQSLYQNSWTLNKGEIWNGGSLTPIAE

SEQ ID NO: 3678 - protein, 365 aa, Bacillus sp.
MFKKISIFILLSSIIISAFSQTASAHTVNPVNPNAQATTKELMNWLAHLPNRSENRILSGAFGGFTNASFSMKEANRIKNATGQLPAIYGCDYSSGWLEKPYISDITETIDYSCNSDLISYWKSGGIPQISLHLANPASSTFGKNASHISNSEYEKILDSSTTEGKRLEAVLSKVADGLDQLKNEGVPVLFRPLHEMNGEWFWWGLTEYNKKDSQRISLYKQLYQKIYHYMTDTRGLDNLIWVYAPDANRDFKIDFYPGSSYVDIVGLDAYFSDAYSIKGYDELTALDKPFAFTEVGPQTKNGSLDYSQFINAVKQKYPKTIYFLAWDEDWSPVANQGASNLYNDSWTLNKGEVWSGSSLTPIVE

SEQ ID NO: 3679 - protein, 347 aa, Paenibacillus sp.
MGILLIASTFSQTASAHTVNPNGQATTKEVMNWLANLSSENRVVSGAFGGYTNASFSMTEANRIENATGQSPAVYGCDYSRGWMETSNIADSIDYSCNTDSISHWKNGGIPQISMHLANPAFNSGNYKTPISNSQYERILDSSTEEGQRLDAMLSKIADGLQQLEDEGVPVLFRPLHEMNGEWFWWGLTDYNQEDSERITLYQQLYKKVYHYMTDTRGLDNLIWVYAPDANRNFKTDFYPGSSYVDIVGLDAYFSDPYSIQGYDELTALDKPFAFTEVGPQATNGSMDYSLFINAIKEKYPKTIYFLAWDEGWSPAANKGAYNLYNDGWTLNKGEMWEGSSLASFAE

SEQ ID NO: 3680 - protein, 209 aa, Bacillus sp.
MTTKFTALAVFLLCFMPASKIEHTQASLLNTKKTKHEEAKLLTHINHDTDTSFSSLSADEDKKKIKPIKLSANTEKKEKEQSEKANEKKETYSESEKELLSRLVHAEAKGESYEGKVAVASVVLNRTDKKGFPDTIRGVIYQKNAFEPVANGSINQEPDKESIEAVEEAMSSKDRETEALFFYNPKTASDDWIRSRKIIEKIGRHVFAI

SEQ ID NO: 3681 - protein, 209 aa, Bacillus sp.
MTTKLTALAVFLLCFMPASKIEHTQASLLNTKKTNHEEAKLLTHINHDTDISFSSLSADEDKKKIKPIKLSANTEKKEEEQSEKTNEKKETYSQSEKELLSRLVHAEAKGESYEGKVAVASVVLNRTDKKGFPDTIRGVIYQKNAFEPVANGSINQEPDKESIEAVEEAMSSKDRETEALFFYNPKTASDDWIRSRKIIEKIGRHVFAI

SEQ ID NO: 3682 - protein, 209 aa, Bacillus sp.
MTTKFTALAVFLLCFMPASKIEHTQASLLSTKKTKHEEAKLLTHINQDTDTSFSSLSADKDKKKIKPIKLSANTEKKEEEKPKKTNDKEETYSQSEKELLSRLVHAEAKGESYEGKVAVASVVLNRTEKKGFPDTIRGVIYQKNAFEPVANGSINQKPDKESIAAAEEALSSKNRETDAIFFYNPKTASDDWIRSRKIVERIGGHVFAI

SEQ ID NO: 3683 - protein, 209 aa, Bacillus sp.
MTTKFTALAVFLLCFMPASKIEHTQASLLSTKKTKHEEAKLLTHINQDTDTSFSSLSADKDKKKIKPIKLSANTEKKEEEKPKKTNDKEETYSQSEKELLSRLVHAEAKGESYEGKVAVASVVLNRTEKKGFPNTIRGVIYQKNAFEPVANGSINQKPDKESIAAAEEALSSKNRETDAIFFYNPKTASDDWIRSRKIVERIGGHVFAI

SEQ ID NO: 3684 - protein, 209 aa, Bacillus sp.
MTTKFTALAVFLLCFMPAAKIEHTQASLLSTKKTKHEEAKWLTHIDQDRDESFPSLSADKDQKKIKPIKLSAHTEKKEKDKPAKTTEKKETYTQSEKDLLSRLVHAEAKGESYKGKVAVASVVLNRTEKKGFPDTIRGVIYQKNAFEPVANGSINQKPDKESIAAAEEALSSKNRETDAIFFYNPKTASDDWIRSRKIIEKIGRHVFAI

SEQ ID NO: 3685 - protein, 209 aa, Bacillus sp.
MTTKFTALAVFLLCFMPAAKIEHTQASLLSTKKTKHEEAKWLTHIDRDRDESFPSLSADKDQKKIKPIKLSAHTEKKEKDKPAKATEKKETYTQSEKELLSRLVHAEAKGESYEGKVAVASVVLNRTEEKGFPDTIRGVIYQKNAFEPVSNGSINQKPDKESIAAAEEALSSKNRETDAIFFYNPKTASDDWIRSRKIVEKIGRHVFAI

SEQ ID NO: 3686 - protein, 208 aa, Bacillus sp.
MTTKFTALAVFLLCFMPAAKIEHTQASLLSAKKTKHEEAKWLTHIDRNTNESFPSLSADKDKKIKPIKLSAHTEKKEKDKPDKTNDEKETYTQSEKELLSRLVHAEAKGESYKGKVAVASVVLNRTEKKGFPDTIRGVIYQKNAFEPVANGSINQKPDKESIEAAEEALSSKNRETDAIFFYNPKTASDNWIRSRKIVEKIGRHVFAV

SEQ ID NO: 3687 - protein, 208 aa, Bacillus sp.
MTTKFTALAVFLLCFMPAAKIEHTQASLLSAKKTKHEEAKWLTHIDRNTNESFPSLSADKDKEIKPIKLSAHTEKKEKDKPDKTNDEKETYTQSEKELLSRLVHAEAKGESYKGKVAVASVVLNRTEKKGFPDTIRGVIYQKNAFEPVANGSINQKPDKESIEAAEEALSKKNRETDAIFFYNPKTASDNWIRSRKIVEKIGRHVFAV

SEQ ID NO: 3688 - protein, 209 aa, Bacillus sp.
MTTKFTALAVFLLCFMPAAKIEHTHASLMSTKKIKHEEAKWLSHIERGTDGSFPSLSADKEKKKIKPIKLSAHTEKKEKDKPAKTTEKKETYTQSEKDLLSRLIHAEAKGESYKGKVAVASVVLNRTEQKGFPDTIRGVIYQKNAFEPVANGSIKQKPDKESIAAAEEALSSQNRETDAIFFYNPKTASDDWIRSRKIIEKIGGHIFAI

SEQ ID NO: 3689 - protein, 217 aa, Bacillus sp.
MTTKFTALAVFLLCFMPAAKIEHTHASLMSTKKTKHEEAKWLTHIDQDRDELFPSLSADKNQNKIKPIKLSAHNEKKEKEKEQEKDKDKPAKTTEKKETYTQSEKDLLSRLVHAEAKGESYKGKVAVASVVLNRTERKGFPDTIRGVIYQKNAFEPVANGSINQKPDKESIAAAEEALSSKSRETDAIFFYNPKTASDDWIRSRKIIEKIGRHVFAI

SEQ ID NO: 3690 - protein, 214 aa, Bacillus sp.
MTTKFAALAVFLLCFMPATKIEHAQASLMLTKKTKPEAKQLLTHINNDEEESFPSLSDDKDKKKVKPIKLSARTEKKEKPNSNETSSHPKEKEERKYSQSEKELLSRLVHAEAKGESYKGKVAVASVVLNRTEERGFPDTIRGVIYQKNAFEPVANGSINQKADKDSIEAAEEVLSDKNRETEAIFFYNPKTASDDWIRSRKVIERIGKHVFAM

SEQ ID NO: 3691 - protein, 335 aa, Salinibacillus sp.
MNAKRWIALVIALGIFGVSIIVSISMSFFESVKGAQTDLTSLTDESQEVTLENGSLSSKIAVLEVSGTIQDNGDSSSLLGSDGYNHRTFLKNLEQAKEDDAVKGIVLKVNSPGGGVYESAEIHKKLEEVKKATKKPIYVSMGSMAASGGYYISTAADKIFATPETLTGSLGVIMESVNYSKLADKLGISFETIKSGAHKDIMSPSREMTKEEKNIMQSMVDNSYEGFVDVISEGRGISKAEVKKIADGRVYDGRQAKKLNLVDEIGFYDDTIAAMKKDHKNLKNASVVSYEESFGLGSLFTMGANKMFKSEIDFLNMREVLSQSGSPRMMYLYAK

SEQ ID NO: 3692 - protein, 335 aa, Bacillus sp.
MNAKRWIALVIALGIFGVSIIVSISMSFFESVKGAQTDLTSLTDESQEVTLENGSLSSKIAVLEVSGTIQDNGDSSSLLGSEGYNHRTFLKNLEQAKEDGAVKGIVLKVNSPGGGVYESAEIHKKLEEVKKETKKPIYVSMGSMAASGGYYISTAADKIFATPETLTGSLGVIMESVNYSKLADKLGISFETIKSGAHKDIMSPSREMTKEEKNIMQSMVDNSYEGFVDVISEGRGLSKTQVKKIADGRVYDGRQAKKLNLVDELGFYDDTIAAMKKDHKNLKNASVVSYEESFGLGSLFSMGANKMFKSEIDFLNMREVLSQSGSPRMMYLYAK

SEQ ID NO: 3693 - protein, 335 aa, Bacillus sp.
MNAKRWIALVIALGIFGVSIIVSISMSFFESVKGAQTDLTSLTDESQEKTLENGSLSSKIAVLEVSGTIQDNGDSSSLLGADGYNHRTFLKNLERAKDDKTVKGIVLKVNSPGGGVYESAEIHKKLEEIKKETKKPIYVSMGSMAASGGYYISTAADKIFATPETLTGSLGVIMESVNYSKLADKLGISFETIKSGAHKDIMSPSREMTKEEKNIMQSMVDNSYEGFVDVISKGRGISKAEVKKIADGRVYDGRQAKKLNLVDELGFYDDTISAMKKDHKDLKNASVISYEESFGLGSLFSMGANKMFKSEIDFLNMREMLSQSGSPRMMYLYAK

SEQ ID NO: 3694 - protein, 335 aa, Bacillus sp.
MNAKRWIALVIALGIFGVSIIVSISMSFFESVKGAQTDLTSLTDESQEKTLENGSLSSKIAVLEVSGTIQDNGDSSSLLGADGYNHRTFLKNLERAKDDKTVKGIVLKVNSPGGGVYESAEIHKKLEEIKKETKKPIYVSMGSMAASGGYYISTAADKIFATPETLTGSLGVIMESVNYSKLADKLGISFETIKSGAHKDIMSPSREMTKEEKNIMQSMVDNSYEGFVDVISKGRSMPKAEVKKIADGRVYDGRQAKKLNLVDELGFYDDTITAMKKDHKDLKNASVISYEESFGLGSLFSMGANKMFKSEIDFLNMREILSQSGSPRMMYLYAK

SEQ ID NO: 3695 - protein, 335 aa, Bacillus sp.
MNAKRWIALVIALGIFGVSIIVSISMSFFESVKGAQTDLTSLTDESQEKTLENGSLSSKIAVLEVSGTIQDNGDSSSLLGADGYNHRMFLKNLERAKDDKTVKGIVLKVNSPGGGVYESAEIHKKLEEIKKETKKPIYVSMGSMAASGGYYISTAADKIFATPETLTGSLGVIMESVNYSKLADKLGISFETIKSGAHKDIMSPSREMTKEEKNIMQSMVDNSYEGFVDVISKGRGMPKAEVKKIADGRVYDGRQAKKLNLVDELGFYDDTVTAMKKDHKDLKNASVISYEESFGLGSLFSMGANKMFKSEIDFLNMREILSQYGSPRMMYLYAK

SEQ ID NO: 3696 - protein, 334 aa, Bacillus sp.
MNAKRWIALVIALGIFGVSLIASLTIAFFENFSGNTDITSLNDESQEVTLEDGNLSSKIAVLEVSGTIQDNGDSSSLLGSDGYNHRTFLKNLEQAKEDKTVKGIVLKVNSPGGGVYESAEIHKKLEEIKKETKKPIYVSMGSMAASGGYYISADADKIYASPETITGSLGVIMESVNYSKLADELGIKFETIKSGAHKDIMSATRDMTDEEKKIMQSMVDNSYEGFVDVISKGRNMSEAEVKKIADGRVYDGKQAKKLNLVDELGFYDDTIAAMKKDHKNLKDASVVTYEESFGLGSLFSMGANKMFKSEIDFLNMKELISQSSSPRMMYLYAK

SEQ ID NO: 3697 - protein, 334 aa, Bacillus sp.
MNAKRWIALVIALGIFGVSLIASLTIAFFENFSGNTDITSLNDESQEVTLEDGNLSSKIAVLEVSGTIQDNGDSSSLLGSDGYNHRTFLKNLEQAKDDKTVKGIVLKVNSPGGGVYESAEIHKKLEEIKKETKKPIYVSMGSMAASGGYYISADADKIYASPETITGSLGVIMESVNYSKLADELGIKFETIKSGAHKDIMSATRDMTDEEKKIMQSMVDNSYEGFVDVISKGRNMSEAEVKKIADGRVYDGKQAKKLNLVDELGFYDDTIAAMKKDHTNLKDASVVTYEESFGLGSLFSMGANKMFKSEIDFLNMKELISQSSSPRMMYLYAK

SEQ ID NO: 3698 - protein, 335 aa, Bacillus sp.
MNAKRWIALVIALGIFGVSVIASVTVGVLKNIGDTGSDFASLTDDTEEVTLDKGSPGSKIAVLEVDGTIEDNGGSAGLLSSGGYDHRLFLKQVERAKEDKSVKGIVLKINSPGGGVYESAEIHKKLEELKKETKKPIYVSMGSMAASGGYYISTAADKIYASPETLTGSLGVIMESVNYSKLADELGIKFETIKSGAHKDIMSPTRDMTKEERKIMQTMVNDSYEGFVNVISKGRHMSKADVKKIADGRVYDGRQAKKIGLVDELGFYDDTISAMKKDHKNMKNASVITYEEGFGLGSLFSMSAAKMFKSEIDFLNMKELISQSGSPRMMYLYAK

SEQ ID NO: 3699 - protein, 335 aa, Bacillus sp.
MNAKRWIALVIALGIFGVSVIASVTVGVLKNIGDTGSDFASLTDDTEEVTLDKGSPGSKIAVLEVDGTIEDNGGSAGLLSSGGYDHRSFLKQVERAKEDKSVKGIVLKINSPGGGVYESAEIHKKLEELKKETKKPIYVSMGSMAASGGYYISTAADKIYASPETLTGSLGVIMESVNYSKLADELGIKFETIKSGAHKDIMSPTRDMTKEERKIMQTMVNDSYEGFVNVISKGRHMSKSDVKKIADGRVYDGRQAKKIGLVDELGFYDDTISAMKKDHKNMKNASVITYEEGFGLGSLFSMSAAKMFKSEVDFLNMKELISQSGSPRMMYLYAK

SEQ ID NO: 3700 - protein, 335 aa, Bacillus sp.
MNPKRWVALVIALAIFGCSLIMSLVLAVFENFGEDSKMQLGLSDGQEETVLEHGSGSSKIAVLEVDGTIADNGDGGSLLGSDGYNHRSFLKMLERAKDDSAVKGIVLRVNSPGGGVYESAEIHKKLEEIKKETKKPIYVSMGSMAASGGYYISTVADKIFAAPDTLTGSLGVIMESMNYGKLAEKLGLKTETIKSGEYKDIMSPTRGMTKKEREIMQAMVDDSYEGFVDVISEGRHMSKADVKKIADGRVYDGRQAKKIHLVDELGYYEDTVKALKKDHKNLDGASVVTYKESTGLSSFLSMSANKIFKSEADFLNIKEAISQSGAPRLMYLYAK

SEQ ID NO: 3701 - protein, 335 aa, Bacillus sp.
MNPKRWIALVIALGIFGFSAVISLVLSVFDSFGEDGKMQFGLNDTQEETVLEQGSSSSKIAVLEVNGTIADNGGASSLLGSDGYNHRAFLKTLEKAKDDSAVKGIILRVNSPGGGVYESAEIHKKLEEIKKETKKPIYVSMGSMAASGGYYISTAADKIYAAPDTLTGSLGVIMESLNYSGLAEKLGLKTETIKSGEFKDIMSPTRDMTKKEREIMQGMVDDAYEGFVDVIADGRHMSESDVKKIADGRVYDGRQAKKINLVDELGYYEDVVKAMKKDHKSMAGASVVSYKESTGLSSLLSMSANKIFKSEVDFLNIKEAISQAGAPRAMYLYAK

SEQ ID NO: 3702 - protein, 335 aa, Bacillus sp.
MNAKRWIALVIALGVFALSAVVSLLLAVFDTMGNDGKMQFGLNDTQEETVLEEGNSSRKIAVLEVNGTISDNGGASGLFSSEGYNHRSFLQMLEKAKDDSAVKGIILRVNSPGGGVYESAEIHKKLEEIKKDTKKPIYVSMGSMAASGGYYISTPADKIFAAPDTLTGSLGVIMESLNYSKLAEKLGLKTETIKSGEFKDIMSPTRDMTKKEREIMQSMVDDAYEGFVDVIADGRSMSENDVKKIADGRVYDGRQAKQNHLIDELGYYEDAVKAMKKDHKNLAGASVVSYEESAGLASLFSMTANKMFKSEADFLNIKEAISQSGAPRLMYLYAK

SEQ ID NO: 3703 - protein, 333 aa, Bacillus sp.
MNAKRWVALIIALGVFGFSIVISVTMALFDSFNDNKMSYQFGDEIEEKVLENGSGAGKIAVLEINGTIQDNGGASSLLGGEGYDHRAFLKELDKAKEDASVKGVLLRVNSPGGGVYESAEIHKKLEEVKKAKKPIYVSMGSMAASGGYYVSTPAKKIFASPETLTGSLGVIMQSLNYSKLADNLGIKYETIKSGKFKDIMSPNRDMTKDERNIMQSMVDNSYEGFVKVISEGRGMSKQEVKKIADGRVYDGTQAKSNGLVDELGYYEDALKAMKKNEKGLKGATVVSYSQSFGWNSLFNMSASKLFKSEIDFLNLKETLAGSNGSKPMYLYSK

SEQ ID NO: 3704 - protein, 333 aa, Bacillus sp.
MNAKRWVALIIALGVFGFSIVISVTMALFDSFNDNKMSYQFGDEIEEKVLENGSGAGKIAVLEINGTIQDNGGASSLLGGEGYDHRAFLKELDKAKEDASVKGVLLRVNSPGGGVYESAEIHKKLEEVKKAKKPIYVSMGSMAASGGYYVSTPAKKIFASPETLTGSLGVIMQSLNYSKLADNLGIKYETIKSGKFKDIMSPNRDMTKDERNIMQSMVDNSYEGFVKVISEGRGMSKQEVKKIADGRVYDGTQAKSNGLVDELGYYEDALKVMKKNEKGLKGATVVSYSQSFGWNSLFNMSASKLFKSEIDFLNLKETLAGSNGSKPMYLYSK

SEQ ID NO: 3705 - protein, 540 aa, Salinibacillus sp.
MRTLFKTSLFMAGLCTAAQCVFASNASADQSIKYDHTYQTPSYIIEKSQPSWQPAQNLTQKEALFSYLDKQQTHFKLKGNANSHFRISKTIKDSKTKQTFFKLEEVYKGIPVYGFGQAVAMKENKQVKSFFGKVHPQINDISVTPSVSKKKAIHTARRALEASIGKIEYVDGEPKAELYIYPHEGAYDLAYLVRLSTSEPEPGYWHYFINAKSGKVIDTFNAIHEAAGTGIGVSGEEKSFEVTEQNGRYYLADETRGKGINTFDAKNLNETLFTLLSQLIGYTGSEVVSGTSVFHDPAAVDAHANAQTVYDYYSRTFGRHSFDQNGARITSTVHVGTQWNNAAWNGVQMVYGDGDGARFKPLSGSLDIVAHEMTHAVTQYSAGLLYQGEPGALNESISDIMAAMTDRDDWEIGEDVYTPYVRGDALRSLEDPSKQGNPDHYSNRYTGTEDYGGVHINSSIHNKAAYLLAEGGVHHDVRVEGVGREACEQIYYRALTYYVTPSSDFSMMKQAAIEAANDLYGEDSKQSASVEKAYDAVGIQ

SEQ ID NO: 3706 - protein, 540 aa, Bacillus sp.
MPTLFKTSLFMAGLCTAAQCVFASNASADQSIKYDHTYQTPSYIIEKSQPSWQPAQNLTQKEALFSYLDKHQTHFKLKGNANSHFRISKTIKDPKTEQTFLKLEEVYKGIPVYGFGQAVAMKENKQVKSFFGKVHPQLNDISVTPSVSKKKAIHTARRALEASIGKIEYVDGEPKAELYIYPHEGAYDLAYLVRLSTSEPEPGYWHYFIHAKSGKVIDSFNAIHEAAGTGIGVSGEEKSFEVTEQNGRYYLADETRGKGINTFDAKNLNETLFTLLSQLIGYTGKEVVSGTSVFKDPAAVDAHANAQTVYDYYSRTFGRHSFDQNGARITSTVHVGKQWNNAAWNGVQMVYGDGDGAKFKPLSGSLDIVAHEMTHAVTQYSAGLLYQGEPGALNESISDIMAAMTDRDDWEIGEDVYTPDVRGDALRSLADPSKQGNPDHYSNRYTGTEDYGGVHINSSIHNKAAYLLAEGGVHHDVRVEGIGREACEQIYYRALTYYVTPSSDFSMMRQAAIEAAKDLYGEGSKQSASVEKAYDAVGIQ

SEQ ID NO: 3707 - protein, 530 aa, Bacillus sp.
MAGLCTAAQCVFASNASADQSIKYDHTYQTPSYIIEKSQPSWQPAQNLTQKEALFSYLDKHQTHFKLKGNANSHFRISKTIKDPKTEQTFLKLEEVYKGIPVYGFGQAVAMKENKQVKSFFGKVHPQLNDISVTPSVSKKKAIHTARRALEASIGKIEYVDGEPKAELYIYPHEGAYDLAYLVRLSTSEPEPGYWHYFIHAKSGKVIDSFNAIHEAAGTGIGVSGEEKSFEVTEQNGRYYLADETRGKGINTFDAKNLNETLFTLLSQLIGYTGKEVVSGTSVFKDPAAVDAHANAQTVYDYYSRTFGRHSFDQNGARITSTVHVGKQWNNAAWNGVQMVYGDGDGAKFKPLSGSLDIVAHEMTHAVTQYSAGLLYQGEPGALNESISDIMAAMTDRDDWEIGEDVYTPDVRGDALRSLADPSKQGNPDHYSNRYTGTEDYGGVHINSSIHNKAAYLLAEGGVHHDVRVEGIGREACEQIYYRALTYYVTPSSDFSMMRQAAIEAAKDLYGEGSKQSASVEKAYDAVGIQ

SEQ ID NO: 3708 - protein, 530 aa, Bacillus sp.
MAGLCTAAQCVFASNASADQSIKYDHTYQTPLYIIEKSQPSWQPAQNLTQKEALFSYLDKHQTHFKLKGNASSHFRISKTTKDPKTKQTFFKLEEVYKGIPVYGFGQAVAMKENKQVKSFFGKVHPQLNDISVTPSVSKKKAIHTARRTLEASIGKIEYVDGEPKAVLFIYPHEGAYDLAYLVRLSTSEPEPGYWHYFIHAKSGKVIDSFNAIHEAAGTGIGVSGEEKSFEVTEQNGRYYLADETRGKGINTFDAKNLNETLFTLLSQLIGYTGKEVVSGTSVFKDPAAVDAHANAQTVYDYYSSTFGRHSFDQNGARITSTVHVGKQWNNAAWNGVQMVYGDGDGAKFKPLSGSLDIVAHEMTHAVTQYSAGLLYQGEPGALNESISDIMAAMTDRDDWEIGEDVYTPDIRGDALRSLADPSKQGNPDHYSNRYTGTEDYGGVHINSSIHNKAAYLLAEGGVHHDVRVEGIGREACEQIYYRALTYYVTPSSDFSMMRQAAIEAAKDLYGEDSKQSASAEKAYDAVGIQ

SEQ ID NO: 3709 - protein, 538 aa, Bacillus sp.
MRNLTKTSLLLAGLCTAAQMVFVTHASADQSIKYDHTYQTPSYIIEKSSQKPVQNTTQKESLFSYLDKHQTQFKLKGNANSHFRISKTIKDPKTKQTFFKLTEVYKGIPIYGFEQAVAMKENKQVKSFFGKVHPQIKDVSITPSISEKKAIHTARRELEASIGKIEYLDGEPKGELYIYPHDGEYDLAYLVRLSTSEPDPGYWHYFIDAKNGKVIESFNAIHEAAGTGIGVSGDEKSFDVTEQNGRFYLADETRGKGINTFDAKNLNETLFTLLSQLIGYTGKEIVSGTSVFNEPAAVDAHANAQAVYDYYSKTFGRDSFDQNGARITSTVHVGKQWNNAAWNGVQMVYGDGDGSKFKPLSGSLDIVAHEITHAVTQYSAGLLYQGEPGALNESISDIMGAMADRDDWEIGEDVYTPGIAGDSLRSLEDPSKQGNPDHYSNRYTGTEDYGGVHINSSIHNKAAYLLAEGGVHHGVQVEGIGREASEQIYYRALTYYVTASTDFSMMKQAAIEAANDLYGEGSKQSASVEKAYEAVGIL

SEQ ID NO: 3710 - protein, 538 aa, Bacillus sp.
MRNLTKTSLLLAGLCTAAQMVFVTHASADQSIKYDHTYQTPSYIIEKSPQKPVQNTTQKESLFSYLDKHQTQFKLKGNANSHFRVSKTIKDPKTKQTFFKLTEVYKGIPIYGFEQAVAMKENKQVKSFFGKVHPQIKDVSITPSISEKKAIHAARRELEASIGKIEYLDGEPKGELYIYPHDGEYDLAYLVRLSTSEPEPGYWHYFIDAKNGKVIESFNAIHETAGTGIGVSGDEKSFDVREQNGRFYLADETRGKGINTFDAKNLNETLFTLLSQLIGYTGKEIVSSTSVFNEPAAVDAHANAQAVYDYYSKTFGRDSFDQNGARITSTVHVGKQWNNAAWNGVQMVYGDGDGSKFKPLSGSLDIVAHEITHAVTQYSAGLLYQGEPGALNESISDIMGAMADRDDWEIGEDVYTPGIAGDSLRSLEDPSKQGNPDHYSNRYTGTEDYGGVHINSSIHNKAAYLLAEGGVHHGVQVEGIGREASEQIYYRALTYYVTASTDFSMMKQAAIEAANDLYGEGSKQSVSVEKAYEAVGIL

SEQ ID NO: 3711 - protein, 538 aa, Bacillus sp.
MRKLTKTSLLLAGLCTATQMVFVTHASADQSIKYDHTYQTPSYIIEKPSQKPVQNTTQKESLFSYLDKHQSHFKLKGNANSHFRVSKTIKDPKTKQTFFKLTEVYKGIPIYGFEQAVAMKDNKQVTSFFGKVHPQIKDVSVTPSISEKKAIRTAQRELEAAIGEIKYLDGEPKGELYIYPHDGEYDLAYLVRLSTSEPEPGYWHYVIDAKNGKVIKSFNAIHEAAGTGIGVSGDEKSFDVTEQNGRFYLADETRGKGINTFDAENLNETLFTLLSQLIGYTGKEIVSGTSVFNEPAAVDAHANAQAVYDYYSKTFGRDSFDQNGARITSTVHVGKQWNNAAWNGVQMVYGDGDGSKFKPLSGSLDIVAHEITHAVTQYSAGLLYQGEPGALNESISDIMGAMADRDDWEIGEDVYTPDIAGDSLRSLEDPSKQGNPDHYSNRYTGTEDYGGVHINSSIHNKAAYLLAEGGVHHNVQVEGIGREACEQIYYRALTYYVTASTDFSMMKQAAIEAANDLYGEGSKQSASVEKAYEAVGIL

SEQ ID NO: 3712 - protein, 519 aa, Bacillus sp.
MVFVTHASADQSIKYDHTYQTPSYIIEKSPQKPVQNTTQKESLFSYLDKHQTQFKLKGNANSHFRISKTIKDPKTKQTFFKLTEVYKGIPIYGFEQAVAMKENKQVKSFFGKVHPQIKDVSVTPSISEQKAIHTARRELEASIGKIDYLDGEPKGELYIYPHDGEYDLAYLVRLSTSEPEPGYWHYFIDAKNGKVIEFFNAIHEAAGTGIGVSGDEKSFDVTEQNGRFYLADETRGKGINTFDAKNLNQTLFTLLSQLIGYTGKEIVSGTSVFNEPAAVDAHANAQAVYDYYSKTFGRDSFDQNGARITSTVHVGKQWNNAAWNGVQMVYGDGDGSKFKPLSGSLDIVAHEITHAVTQYSAGLLYQGEPGALNESISDIMGAMADRDDWEIGEDVYTPDIAGDSLRSLEDPSKQGNPDHYSNRYTGTEDYGGVHINSSIHNKAAYLLAEGGVHHDVQVEGIGREASEQIYYRALTYYVTASTDFSMMKQAAIEAANDLYGEGSKQSASVEKAYEAVGIL

SEQ ID NO: 3713 - protein, 519 aa, Bacillus sp.
MVFVTHASAEESIEYDHTYQTPSYIIEKSPQKPVQNTTQKESLFSYLDKHQTQFKLKGNANSHFRVSKTIKDPKTKQTFFKLTEVYKGIPIYGFEQAVAMKENKQVKSFFGKVHPQIKDVSVTPSISEKKAIHTARRELEASIGKIEYLDGEPKGELYIYPHDGEYDLAYLVRLSTSEPEPGYWHYFIDAKNGKVIESFNAIHEAAGTGIGVSGDEKSFDVTEQNGRFYLADETRGKGINTFDAKNLNETLFTLLSQLIGYTGKEIVSGTSVFNEPAAVDAHANAQAVYDYYSKTFGRDSFDQNGARITSTVHVGKQWNNAAWNGVQMVYGDGDGSKFKPLSGSLDIVAHEITHAVTQYSAGLLYQGEPGALNESISDIMGAMADRDDWEIGEDVYTPGIAGDSLRSLEDPSKQGNPDHYSNRYTGTEDYGGVHINSSIHNKAAYLLAEGGVHHGVQVEGIGREASEQIYYRALTYYVTASTDFSMMKQAAIEAANDLYGEGSKQSASVEKAYEAVGIL

SEQ ID NO: 3714 - protein, 519 aa, Bacillus sp.
MVFVTHASAEESIEYDHTYQTPSYIIEKSPQKPVQNTTQKESLFSYLDKHQTQFKLKGNANSHFRVSKTIKDPKTKQTFFKLTEVYKGIPIYGFEQAVAMKENKQVKSFFGKVHPQIKDVSVTPSISEKKAIHTARRELEASIGKIEYLDGEPKGELYIYPHDGEYDLAYLVRLSTSEPDPGYWHYFIDAKNGKVIESFNAIHEAAGTGIGVSGDEKSFDVTEQNGRFYLADETRGKGINTFDAKNLNETLFTLLSQLIGYTGKEIVSGTSVFNEPAAVDAHANAQAVYDYYSKTFGRDSFDQNGARITSTVHVGKQWNNAAWNGVQMVYGDGDGSKFKPLSGSLDIVAHEITHAVTQYSAGLLYQGEPGALNESISDIMGAMADRDDWEIGEDVYTPGIAGDSLRSLEDPSKQGNPDHYSNRYTGTEDYGGVHINSSIHNKAAYLLAEGGVHHGVQVEGIGREASEQIYYRALTYYVTASTDFSMMKLAAIEAANDLYGEGSEQSASVEKAYEAVGIL

SEQ ID NO: 3715 - protein, 519 aa, Bacillus sp.
MVFVTHASADQSIKYDHTYQTPSYIIEKPSQKPVQNTTQKESLFSYLDKHQSHFKLKGNANSHFRISKTIKDSKTKQTFFKLTEVYKGIPIYGFEQVVAMKDNKQVTSFFGKVHPQIKDVSVTPSISEKKAIRTAQRELEAAIGKIKYLDGEPKGELYIYPHDGKFDLAYLVRLSTSEPEPGYWHYVIDAKNGKVIESFNAIHEAAGTGIGVSGDEKSFDVTVQDGRFYLADETRGKGINTFDAENLNETLFTLLSQLIGYTGKEIVSGTSVFNEPAAVDAHANAQAVYDYYSKTFGRDSFDQNGARITSTVHVGKQWNNAAWNGVQMVYGDGDGSKFKPLSGSLDIVAHEITHAVTQYSAGLLYQGEPGALNESISDIMGAMADRDDWEIGEDVYTPDIAGDSLRSLEDPSKQGNPDHYSNRYTGTEDYGGVHINSSIHNKAAYLLAEGGVHHNVQVEGIGREACEQIYYRALTYYVTASTDFSMMKQAAIEAANDLYGEGSKQSASVEKAYEAVGIL

SEQ ID NO: 3716 - protein, 382 aa, Bacillus sp.
MRIFKKAVLIVIISFLFANVNVNTAHAAINVSAKSAIVIDGTSGRVLFAKDEHEKRRIASITKIMTAVLAIESGKMEETVTVSANAVRTEGSAIYLTEGQKVKLKDLVYGLMLRSGNDAAVAIAEYVGGSLDGFVYMMNQKAEQIGMENTRFQNPHGLDDHENHYSTAYDMAVLTKYAMKLKDYQTISGTKIYKAETMESVWKNKNKLLTMLYPYSTGGKTGYTKLAKRTLVSTASKDGVDLIAVTINDPDDWDDHMNMFNYVFDHYQTYLIAKKGDIPKLKGTFYESKAFIKRDITYLLTEEEKEDVKINTTLLKPKKAWEKDVSKIPDIVGHMKVMFNDEIIAKVPIYYENERNQKPKKKFFETFQSIFLNAAGGAKWSI

SEQ ID NO: 3717 - protein, 382 aa, Bacillus sp.
MRIFKKAVLIVIISFLFANVNVNTAHAAINVSAKSAIVIDGTSGRVLFAKDEHEKRRIASITKIMTAVLAIESGKMEETVTVSANAVRTEGSAIYLTEGQKVKLKDLVYGLMLRSGNDAAVAIAEYVGGSLDGFVYMMNQKAEQIGMENTRFQNPHGLDDHENHYSSAYDMAILTKYAMKLKDYQTISGTKVYKAETMESVWKNKNKLLTMLYPYSTGGKTGYTKLAKRTLVSTASKDGVDLIAVTINDPDDWDDHMNMFNYVFEHYQTYLIAKKGDIPKLKGTFYESKAFIKRDITYLLTEEEKEDVKINTTLLKPKKAWEKDASKIPDIVGHMKVMFNDETIAKVPIYYENERNQKPKKKFFETFKSIFLNAAGGAKWSI

SEQ ID NO: 3718 - protein, 382 aa, Bacillus sp.
MRIFKKAVFMVMIFFLFANVNVNTAHAAIDVSAKSAIVIDGDSGRVLFAKDEHEKRRIASITKIMTAVLAIESGKMEETVTVSANAVRTEGSAIYLTEGQKVKLKDLVYGLMLRSGNDAAVAIAEHVGGSLDGFVYMMNQKAEQLGMENTRFQNPHGLDDHENHYSTAYDMAILTKYAMKLKDYQKISGTKIYKAETMESVWKNKNKLLTMLYRYSTGGKTGYTKLAKRTLVSTASKDGIDLIAVTINDPDDWDDHMNMFNYVFDHYKTYLIAKKGDIPKLKGTFYESKAFIKRDITFLLTEEEKEDVEIRTTLLKPKKAWEKDASKIPDIVGHMKIMFNDETIAKVPIYYENERHQKPKKQFFETFKSIFLNAAGGAKWSI

SEQ ID NO: 3719 - protein, 382 aa, Bacillus sp.
MRIFKKAVFMVMISFLIANVNVNTAHAAIDVSAKSAIVIDGASGRVLFAKDEHEKRRIASITKIMTAVLAIESGKMDETVTVSANAVRTEGSAIYLTEGQKVKLKDLVYGLMLRSGNDAAVAIAEHVGGSLDGFVYMMNQKAEQLGMENTRFQNPHGLDDHENHYSTAYDMAILTKYAMKLKDYQKISGTKIYKAETMESVWKNKNKLLTMLYRYSTGGKTGYTKLAKRTLVSTASKDGIDLIAVTINDPNDWDDHMKMFNYVFDHYQTYLIAKKGDIPKLKGTFYESKAFIKRDITYLLTEEEKGDVNIKTTLLKPKKTWEKDASKIPDIVGHMKIMFNDETIAKVPIYYENERHQKPKKQFFETFKSIFLNAAGGAKWSI

SEQ ID NO: 3720 - protein, 382 aa, Bacillus sp.
MRIFKKAVFVIMISFLIATVNVNTAHAAIDVSAKSAIIIDGASGRVLFAKDEHQKRRIASITKIMTAVLAIESGKMDQTVTVSANAVRTEGSAIYLTEGQKVKLKDLVYGLMLRSGNDAAVAIAEHVGGSLDGFVYMMNQKAEQLGMENTRFQNPHGLDDHENHYSTAYDMAILTKYAMKLKDYQKISGTKIYKAETMESVWKNKNKLLTMLYPYSTGGKTGYTKLAKRTLVSTASKDGINLIAVTINDPDDWDDHMKMFNYVFDHYQTYLIAKKGDIPKLKDTFYESKAFIKRDITYLLNEEEKEDVKINTTLLKPKKAWEKDASKIPDIVGHMEIMFNNETIAKVPIYYENERHQKPKKQFFETFKSIFLNAAGGAKWSI

SEQ ID NO: 3721 - protein, 382 aa, Bacillus sp.
MRIFKKAVFVIMISFLIATVNVNTAHAAIDVSAKSAIIIDGASGRVLYAKDEHQKRRIASITKIMTAVLAIESGKMDQTVTVSANAVRTEGSAIYLTEGQKVKLKDLVYGLMLRSGNDAAVAIAEHVGGSLDGFVYMMNQKAEQLGMKNTRFQNPHGLDDHENHYSTAYDMAILTKYAMKLKDYQKISGTKIYKAETMESVWKNKNKLLTMLYPYSTGGKTGYTKLAKRTLVSTASKDGINLIAVTINDPNDWDDHMKMFNYVFEHYQTYLIAKKGDIPKLKGTFYESKAFIKRDITYLLTEEEKEDVKINTTLLKPKKAWEKDASKIPDIVGHMEIMFNDATIAKVPIYYENERHQKPKKQFFETFKSIFLNAAGGAKWSI

SEQ ID NO: 3722 - protein, 382 aa, Bacillus sp.
MRIFKKAVFVIMISFLIATVNVNTAHAAIDVSAKSAIIIDGASGRVLYAKDEHQKRRIASITKIMTAVLAIESGKMDQTVTVSANAVRTEGSAIYLTEGQKVKLKDLVYGLMLRSGNDAAVAIAEHVGGSLDGFVYMMNQKAEQLGMKNTRFQNPHGLDDHENHYSTAYDMAILTKYAMKLKDYQKISGTKIYKAETMESVWKNKNKLLTMLYPYSTGGKTGYTKLAKRTLVSTASKDDIDLIAVTINDPNDWDDHMKMFNYVFEHYQTYLIAKKGDIPKLKGTFYESKAFIKRDITYLLSEEEKEDVKINTTLLKPKKAWEKDASKIPDIVGHMEIMFNNATIAKVPIYYENERHQKPKKQFFETFKSIFLNAAGGAKWSI

SEQ ID NO: 3723 - protein, 383 aa, Bacillus sp.
MRFLKKAAVIILVTAFLLTFIKEHKAYAAINVSAKSAIVIDGASGRVLFAKDEHEKRRIASITKIMTAVLAIESGKMEETVTVSANAVRTEGSAIYLKEGQKVKLKDLVYGLMLRSGNDAAAAIAEHVGGSLGGFVYMMNQKAEQIGMENTRFQNPHGLDDHENHYSTAYDMAILTKYAMKLKDYQTISGTKVYKAETMESVWKNKNKLLTGLYQYSTGGKTGYTKLAKRTLVSTASKDGTDLIAVTINDPNDWDDHMNMFEYVFNHYKTYIVAKKGDIPKLKETFYGSRAFIKRDVTYLLNEAEKDEVKINTTLLKPKKAWKKDRSAIPDVVGQMTVTVNDETIVKLPIYYENERNKKPKKRFFETFKAIFSNAAGGSEWSI

SEQ ID NO: 3724 - protein, 383 aa, Bacillus sp.
MRFLKKAAVFLLTFVILFSITDGNTAHAQIHVSAKSAIIIDGASGRVLFAKDEHHKRRIASITKIMTAVLAIESGKMEETVTVSPNAVKTEGSAIYLQPGQKVKLKDLVYGLMLRSGNDAAAAIAEYVGGSLDGFVFMMNKKAEQIGMENTKFQNPHGLDDHENLYSTAYDMALLTKYAMKIKEYRTVSGTKVYKAETMDRVWKNKNKLLTGLYRYSTGGKTGYTKIAKRTLVSTASKDGTDLIAVTINDPDDWDDHMNMFNYVFDHYKTYVVAKKGGIPKLKKTFYGKRAFIARDVKYLLKEDEIDDVKIRTTLIKPKKAWKKDASLIPDVVGRMTVMHDGKVIARIPVYYENERHKKPKKHFIETFTSLFMSAAGGSSWSI

SEQ ID NO: 3725 - protein, 383 aa, Bacillus sp.
MRFLKKAAVFLLTFVILFSITDGNTAHAQIHVSAKSAIIIDGASGRVLFAKDEHHKRRIASITKIMTAVLAIESGKMEETVTVSPNAVKTEGSAIYLQPGQKVKLKDLVYGLMLRSGNDAAAAIAEYVGGSLDGFVFMMNKKAEQIGMENTKFQNPHGLDDHENLYSTAFDMALLTKYAMKIKEYRTVSGTKVYKAETMDRVWKNKNKLLTGLYRYSTGGKTGYTKIAKRTLVSTASKDGTDLIAVTINDPDDWDDHMNMFNYVFEHYKTYVVAKKGGIPKLKKTFYGKRAFIARDVKYLLKEDEIDDVKIRTTLIKPKKAWKKDASLIPDVVGRMTVMHDGKVIARIPVYYENERHKKPKKHFIETFTSLFMSAAGGSSWSI

SEQ ID NO: 3726 - protein, 384 aa, Bacillus sp.
MRFFLKQAAAAIMICSLLCSSYETAQAQPSLHISAKSAIVMDGQSGRVLFAKDEHEKRRIASITKIMTAILAVESGKLDETVTVSDRAVRTEGSSIYLTSGQKVKLKDLVYGLMLRSGNDAAVAIAEHVGGSLEGFVYMMNQKAAELGMENTLFRNPHGLDDHPDHYSSAYDMALLTKYAMTNETYKKIAGTKRYKAETMQGIWRNKNKLLTGLYKYSTGGKTGYTKLAKRTLVSTSSKDGTDLIAVTINAPDDWNDHMNMFNYVFGHYKTYIIAKKGEIPKLKDSFYGNKAFIKRDVTYLLNEEEKEDVKVDIELLEPKKSWRKNKKEIPDIIGEMNVMFDGKTIASVPIYYENERNKKPKKSFFETFQSVFQKAAGGSSWSI

SEQ ID NO: 3727 - protein, 384 aa, Bacillus sp.
MRFFLKQAAAAIIICSLLCSSYQIAEAQPSLHVSARSAIVMDGQSGRVLFAKDEHEKRRIASITKIMTAILAVESGKLDETVTVSDRAVKTEGSSIYLTSGQKVKLKDLVYGLMLRSGNDAAVAIAEHVGGSLEGFVYMMNQKAADLGMENTLFRNPHGLDDHPDHYSSAYDMALLTKYAMTNETYQKIAGTKRYKAETMQGIWRNKNKLLTGLYEYSTGGKTGYTKLAKRTLVSTSSKDGTDLIAVTINAPDDWNDHMNMFNYVYGHYKTYIIAKKGEVPKLKDSFYGNKAFIKRDVTYLLNEDEKEDVKVDIELLKPKKSWRKNKKEIPDIIGEMNVMFNGKTIASVPIYYENERNKKPKKSFFETFQSVFQKAAGGSSWSI

SEQ ID NO: 3728 - protein, 384 aa, Bacillus sp.
MRFFLKQAAAAIIICSLLCSSYQIAEAQPSLHVSARSAIVMDGQSGRVLFAKDEHEKRRIASITKIMTAILAVESGKLDETVTVSDRAVKTEGSSIYLTSGQKVKLKDLVYGLMLRSGNDAAVAIAEHVGGSLEGFVYMMNQKAADLGMENTLFRNPHGLDDHPDHYSSAYDMALLTKYAMTNETYQKIAGTKRYKAETMQGIWRNKNKLLTGLYEYSTGGKTGYTKLAKRTLVSTSSKDGTDLIAVTINAPDDWNDHMNMFNYVYGHYKTYIIAKKGEVPKLKDSFYGNKAFIKRDVTYLLNEDETEDVKVDIELLKPKKSWRKNKKEIPDIIGEMNVIFDGKTIASVPIYYENERNKKPKKSFFETFQSVFQKAAGGSSWSI

SEQ ID NO: 3729 - protein, 383 aa, Bacillus sp.
MRFLKRTAAAAILFFLFFSSFQIAEAEASIHVSAKSAIVIDGQSGRVLFAKDEHEKRRIASITKIMTAILAIESGKLEDTVTVSDRAAGTEGSSIYLTSGQKVKLKDLVYGLMLRSGNDAAVAIAEHVGGSLEGFVYMMNQKAADLGMENTVFRNPHGLDDHAGHYSTAYDMALLTKYAMTNQTYRKIAGTKHYKAETMQGIWRNKNKLLTGLYRYSTGGKTGYTKLAKRTLVSTSSKDGTDLIAVTINAPDDWNDHINMFSYCYDHYKTYVVAKKGEIHRLRDSFYGSKVFIKRDVKYLLSDEEKDEVKIDLELLEPKKSWRKNEKAIPDIIGRMKVKLDGKTIADLPVYYENERNKKPKKSFLDTFQSVFKKAAGGPSWSI

SEQ ID NO: 3730 - protein, 326 aa, Bacillus sp.
MKVVLSALLLLLFAFEPFASGKELSDPVLSKRMELYHKVEAVTQIPWYALAAVDQYEENVRSNRKDLPDKTGIISIYVPDEIWSGPENPNPKDDAPLSIKVFDGIGMDGDGDGKAEVSNDEDILYTFAQYLLSHGTDEENIRIGLWNYYRRDQTVGIISEFMKLFKAYGHIDLGEHAFPLPIRTDYSYRSTWGDARGFGGRRIHEGTDIFAHYGLPVKSTCYGVIEMKGWNRFGGWRIGIRDINNTYHYFAHLNGFAKGIKPGQIVEPGQVIGSVGSSGYGPPGTAGKFPPHLHYGMYKDNGKTEWSFDPYPHLRAWERYEYKKKK

SEQ ID NO: 3731 - protein, 326 aa, Bacillus sp.
MKVLLSALLLLLFAFEPYASGKELSDPVLSKRMELYHKIEAVTQIPWYALAAVDQYEENVRSNRKDLPDKAGIISIYIPDEVWSGPENPNPKDDAPLSIKVFDGIGMDGDGDGKAEVSNDEDILYTFSQYLLSYGTDEDNIRIGLWNYYRRDQTVGIISEFMKLFKAYGHIDLGEHAFPLPIRTDYSYRSTWGDARGFGGRRIHEGTDIFAHYGLPVKSTCYGVVEMKGWNRFGGWRIGIRDINNTYHYFAHLNGFAKGIKTGQIVEPGQVIGSVGSSGYGPPGTAGKFPPHLHYGMYKDNGKTEWSFDPYPHLRAWERYEYKKKK

SEQ ID NO: 3732 - protein, 326 aa, Bacillus sp.
MKVLLSALLLLLFAFEPSASGKKLSDPVLSKRMELYHKIEAVTQIPWYALAAVDQYEENVRSNRKDLPDKAGIISIYIPDDIWSGPENPNPKDDAPLSIKVFDGIGMDGDGDGKAEVSNDEDILYTFSQYLLSYGTDEDNIRIGLWNYYRRDQTVGIISEFMKLFKAYGHIDLGEHAFPLPIRTDYSYRSTWGDARGFGGRRIHEGTDIFAHYGLPVKSTCYGVVEMKGWNRFGGWRIGIRDINNTYHYFAHLNGFAKGIKTGQIVEPGQVIGSVGSSGYGPPGTAGKFPPHLHYGMYKDNGRTEWSFDPYPHLRAWERYEYQKKK

SEQ ID NO: 3733 - protein, 326 aa, Bacillus sp.
MKVLLSALLLLLFAFEPSASGKKLSDPVLSKRMELYHKIEAVTQIPWYALAAIDQYEENVRSNRKDLPDKAGIISIYIPDDIWSGPENPNPKDDAPLSIKVFDGIGMDGDGDGKAEVSNDEDILYTFSQYLLSYGTDEDNIRIGLWNYYRRDQTVGIISEFMKLFKAYGHIDLGEHSFPLPIRTDYSYRSTWGDARGFGGRRIHEGTDIFAHYGLPVKSTCYGVVEMKGWNRFGGWRIGIRDINNTYHYFAHLNGFAKGIKTGQIVEPGQVIGSVGSSGYGPPGTAGKFPPHLHYGMYKDNGRTEWSFDPYPHLRAWERYEYQKKK

SEQ ID NO: 3734 - protein, 332 aa, Bacillus sp.
MKGDYFVKVLLSALLLLLFAFEPSASGKKLSDPVLSKRMELYHKIEAVTQIPWYALAAVDQYEENVRSNRKDLPDKAGIISIYIPDDIWSGPENPNPKDDAPLSIKVFDGIGMDGDGDGKAEVSNDEDILYTFSQYLLSYGTDEDNIRIGLWNYYRRDQTVGIISEFMKLFKAYGHIDLGEHAFPLPIRTDYSYRSTWGDARGFGGRRIHEGTDIFAHYGLPVKSTCYGVVEMKGWNRFGGWRIGIRDINNTYHYFAHLNGFAKGIKTGQIVEPGQVIGSVGSSGYGPPGTAGKFPPHLHYGMYKDNGRTEWSFDPYPHLRAWERYEYQKKK

SEQ ID NO: 3735 - protein, 332 aa, Bacillus sp.
MKGDYFVKVLLSALLLLLFAFEPSASGKKLPDPVLSKRMELYHKIEAVTQIPWYALAAVDQYEENVRSNRKDLPEKAGIISIYIPDDIWSGPENPNPKDDAPLSIKVFDGIGMDGDGDGKAEVSNDEDILYTFSQYLLSYGTDEDNIRIGLWNYYRRDQTVGIISEFMKLFKAYGHIDLGEHAFPLPIRTDYSYRSTWGDARGFGGRRIHEGTDIFAHYGLPVKSTCYGVVEMKGWNRFGGWRIGIRDINNTYHYFAHLNGFAKGIKTGQIVEPGQVIGSVGSSGYGPPGTAGKFPPHLHYGMYKDNGRTEWSFDPYPHLRAWERYEYQKKK

SEQ ID NO: 3736 - protein, 317 aa, Bacillus sp.
MKVLLSALLLLLFAFEPSASGKKLSDPVLSKRMELYHKIEAVTQIPWYALAAIDQYEENVRSNRKDLPEKAGIISIYIPDDIWSGPENPNPKDDAPLSIKVFDGIGMDGDGDGKAEVSNDEDILYTFSQYLLSYGTDEDNIRIGLWNYYRRDQTVGIISEFMKLFKAYGHIDLGEHAFPLPIRTDYSYRSTWGDARGFGGRRIHEGTDIFAHYGLPVKSTCYGVVEMKGWNRFGGWRIGIRDINNTYHYFAHLNGFAKGIKTGQIVEPGQVIGSVGSSGYGPPGTAGKFPPHLHYGMYKDNGRTEWSFDPYPHLRAW

SEQ ID NO: 3737 - protein, 326 aa, Bacillus sp.
MKIVLSALLLLLFAFEPSISGKEKPDSVLSARMELYRKAEAVTQIPWYALAAVDQYEENVRSNRNDLPEKSGIISIYIPDDIWSGPENPNPKDDAPLSIKVFDGIGMDGDGDGKAEVSNDEDILYTFAQYLLSYGTDVDNIRIGLWNFYHRDQTVGIITEFMKLFKAYGHIDLGEHAFPLPVRTDYSYRSTWGDARGFGGRRIHEGTDLFAHYGMPVRSTCYGVIEMKGWNRFGGWRIGIRDVNNTYHYFAHLNGFAKGIKTGQIVEPGQVIGSVGSSGYGPPGTAGKFPPHLHYGMYKDNGRTEWSFDPYPHLRAWERFEIRKKK

SEQ ID NO: 3738 - protein, 349 aa, Bacillus sp.
MITDIFKPGCRKLCVFNMKGDYFVKVLLSALLLLLFAFEPSASGKKLSDPVLSKRMELYHKIEAVTQIPWYALAAVDQYEENVRSNRKDLPEKAGIISIYIPDDIWSGPENPNPKDDAPLSIKVFDGIGMDGDGDGKAEVSNDEDILYTFSQYLLSYGTDEDNIRIGLWNYYRRDQTVGIISEFMKLFKAYGHIDLGEHAFPLPIRTDYSYRSTWGDARGFGGRRIHEGTDIFAHYGLPVKSTCYGVVEMKGWNRFGGWRIGIRDINNTYHYFAHLNGFAKGIKTGQIVEPGQVIGSVGSSGYGPPGTAGKFPPHLHYGMYKDNGRTEWSFDPYPHLRAWERYEYQKKK

SEQ ID NO: 3739 - protein, 325 aa, Bacillus sp.
MKVLLSALLLLSVFCPAASGKEQSAPVYGERMQLYRKAEAVTQIPWYVLAAVDQYEENVRSNRKDLPEKAGIISIYIPDHLWSGPENPNPKDDAPLSIKVFDGIGLDGDGDGKAEVSNDEDILYTFAQYLAGFGTDLDHIRIGLWNYYRRDQTVGIITEFMKLFKTFGRLDLGEHAFPLPVKTDYSYRSTWGAARGFGGRRIHEGTDLFAHYGLPVRSTCYGIVEMKGWNRFGGWRIGIRDINNTYHYFAHLNGFAKGVHKGQIVKPGEVIGSVGSSGYGPPGTAGKFPPHLHYGMYKDNGRSEWSFDPYPHLRAWERKEIRRKK

SEQ ID NO: 3740 - protein, 325 aa, Bacillus sp.
MKVLLSALLLLSFFCPAASGKEQSAPVYGERMQLYRKAEAVTQIPWYVLAAVDQYEENVRSNRKDLPEKAGIISIYIPDHLWSGPENPNPKDEAPLSIKVFDGIGLDGDGDGKAEVSNDEDILYTFAQYLAGFGTDLDHIRIGLWNYYRRDQTVGIITEFMTLFKTFGRLDLGEHAFPLPVKTDYSYRSTWGAARGFGGRRIHEGTDLFAHYGLPVRSTCYGIVEMKGWNRFGGWRIGIRDINNTYHYFAHLNGFAKGVHKGQIVKPGEVIGSVGSSGYGPPGTAGKFPPHLHYGMYKDNGRSEWSFDPYPHLRAWERKEIRRKK

SEQ ID NO: 3741 - protein, 325 aa, Bacillus sp.
MKVLLSALLLFSVFCPAASGKEQSALVYGERMQLYRKAEAVTQIPWYVLAAVDQYEENVRSNRKDLPEKAGIISIYIPDHLWSGPENPNPKDDAPLSIKVFDGIGLDGDGDGKAEVSNDEDILYTFAQYLAGFGTDLDHIRIGLWNYYRRDQTVGIITEFMTLFKTFGRLDLGEHAFPLPVKTDYSYRSTWGAARGFGGRRIHEGTDLFAHYGLPVRSTCYGIVEMKGWNRFGGWRIGIRDINNTYHYFAHLNGFAKGVHKGQIVKPGEVIGSVGSSGYGPPGTAGKFPPHLHYGMYKDNGRSEWSFDPYPHLRAWERKEIRRKK

SEQ ID NO: 3742 - protein, 335 aa, Bacillus sp.
MYSILKGDHVVKVLLSALLLLSVFCPAASGKEQSAPVYGERMQLYRKAEAVTQIPWYVLAAVDQYEENVRSNRKDLPEKAGIISIYIPDHLWSGPENPNPKDDAPLSIKVFDGIGLDGDGDGKAEVSNDEDILYTFAQYLAGFGTDLDHIRIGLWNYYRRDQTVGIITEFMTLFKTFGRLDLGEHAFPLPVKTDYSYRSTWGAARGFGGRRIHEGTDLFANYGLPVRSTCYGIVEMKGWNRFGGWRIGIRDINNTYHYFAHLNGFAKGMHKGRIVKPGEVIGSVGSSGYGPPGTAGKFPPHLHYGMYKDNGRSEWSFDPYPHLRAWERKEIRRKK

SEQ ID NO: 3743 - protein, 326 aa, Bacillus sp.
MKVVLSVLILLLFSSQPAAFGQEKKEPDLQTRMALYHKTEAATHIPWYVFAAVDQYEINIRKNRRDLPKQKGYTGIYIPQSVWSGPENPNPNDTSPLSIKVFDGIGMDGNGDGRAESDQDEDVLYTFGQYLLTYGRDIDNIRIGLWEFYERDQTVGIISGFMRLFQTYGHIDLGKHAFPLPVKSDYSYRSTWGDARGFGGRRIHEGTDLFAHFGLPVRSTCYGIIEMKGWNRFGGWRIGIRDINNTYHYFAHLNGFTKGLKVGQIVEPGQVIGSVGNTGYGPPGTAGKFPPHLHYGMYKDNGRTEWSFDPYPHLRAWERKEIRKKK

SEQ ID NO: 3744 - protein, 326 aa, Bacillus sp.
MKAVLSVLILLLLILQPCALAKEKKEPDLQKRMALYHKTEAATHIPWYVFAAVDQYEINIRKNRKDLPKQKGHTGIYIPQSVWSGPENPNPKDTSPLSIKVFDGIGMDGNGDGLAEPDQDEDVLYTFGQYLLTYGRDIENIRIGLWEFYERDQTVGIISGFIRLFQKYGHIDLGKHAFPLPVRSDYSYRSTWGDARGFGGRRIHEGTDLFAHYGLPVRSTCYGIVEMKGWNRFGGWRIGIRDINNTYHYFAHLNGFTKGLKVGEIVEPGQVIGSVGATGYGPPGTSGKFPPHLHYGMYKDNGRTEWSFDPYPHLKAWERKELRKKK

SEQ ID NO: 3745 - protein, 330 aa, Bacillus sp.
MKAVLSVLILLLLILQPCALAKEKKEPDLQKRMALYHKTEAATHIPWYVFAAVDQYEINIRKNRKDLPKQKGHTGIYIPQSVWSGPENPNPKDTSPLSIKVFDGIGMDGNGDGLAEPDQDEDVLYTFGQYLLTYGRDIENIRIGLWEFYERDQTVGIISGFIRLFQKYGHIDLGKHAFPLPVRSDYSYRSTWGDARGFGGRRIHEGTDLFAHYGLPVRSTCYGIVEMKGWNRFGGWRIGIRDINNTYHYFAHLNGFTKGLKVGEIVEPGQVIGSVGATGYGPPGTSGKFPPHLHYGMYKDNGRTEWSFDPYPHLKAWERKELRKELRKKK

SEQ ID NO: 3746 - protein, 326 aa, Bacillus sp.
MKVVLAIMIALSMLPLPVHAKGTGKQPDELKQRMALYEKVSITTQVPWYVLAAVDQYEHNIRKSRRDLPKQKGVIGIYIPREMWIGPENPNKQDTSPLSIKVFDGIGLDGNGDGKASSDDDEDVLFTFAQYLLHYGSNIDQLKIGLWDYYGRDQTVGIISSFMKLYKHYGHLDLGKHAFPLPVGADYSYRSTWGDARGFGGRRIHEGTDLFAHYGLPVRATSYGVIEMKGWNRFGGWRIGIRDIHNHYHYFAHLNGFAKGLKTGQIVEPGQVIGSVGSSGYGPPGTAGKFPPHLHYGMYKDNGRTEWSFDPYPHLRAWERAERKRK

SEQ ID NO: 3747 - protein, 326 aa, Bacillus sp.
MKLVLAIIIALSMIPAPVHAQGANKQPDELKQRMALYEKIAITTQVPWYVLAAVDQYEHNIRKSRRDLPKQTGVIGIYIPREMWIGPENPNKQDTSPLSIKVFDGIGLDGNGDGKAEIDNDEDVLFTFAQYLLHYGSSIDQLKIALWDYYGRDLTVGIISSFMKLYQHYGHLDLGKHAFPLPVGADYSYRSTWGDARGFGGRRIHEGTDLFAHYGLPVRATSYGVIEMKGWNRFGGWRIGIRDIHNHYHYFAHLNGFAKGLKAGQIVEPGQVIGSVGSSGYGPPGTAGKFPPHLHYGMYKDNGRTEWSFDPYPHLRAWERAERKRH

SEQ ID NO: 3748 - protein, 335 aa, Bacillus sp.
MLDERRWTFVKVVLAIMIALSMLPLPVHAQGEGKQPDVLKQRMALYEKVAITTQVPWYVLAAVDQYEHNIRKSRRDLPKQKGVIGIYIPREMWIGPENPNKQDTSPLSIKVFDGIGLDGNGDGKANSDDDEDVLFTFAQYLLHYGNSIDQLKIALWDYYGRDQTVGIISSFMKLYQHYGHLDLGKHAFPLPVGADYSYRSTWGDARGFGGRRIHEGTDLFAHYGLPVRATSYGVIEMKGWNRFGGWRIGIRDIHNHYHYFAHLNGFAKGLKTGQIVEPGQVIGSVGSSGYGPPGTAGKFPPHLHYGMYKDNGRTEWSFDPYPHLRAWERAERKRH

SEQ ID NO: 3749 - protein, 335 aa, Bacillus sp.
MLDERRWTFVKVVLAIMIALSMLPLPVHAQGEGKQPDVLKQRMALYEKVAITTQVPWYVLAAVDQYEHNIRKSRRDLPKQKGVIGIYIPREMWIGPENPNKQDTSPLSIKVFDGIGLDGNGDGKASSDDDEDVLFTFAQYLLHYGNSIDQLKIALWDYYGRDQTVGIISSFMKLYQHYGHLDLGKHAFPLPVGADYSYRSTWGDARGFGGRRIHEGTDLFAHYGLPVRATSYGVIEMKGWNRFGGWRIGIRDIHNHYHYFAHLNGFAKGLKAGQIVEPGQVIGSVGSSGYGPPGTAGKFPPHLHYGMYKDNGRTEWSFDPYPHLRAWERAERKRH

SEQ ID NO: 3750 - protein, 880 aa, Salinibacillus sp.
MKKRLIAPMLLSAASLAFFTITGSAQAAAYTDYSIYKVEPAKTFSTESQASQAAAKLEKDTGWDASYQASGTTATYQITATGIHSEAQAKTVLSGLTKQTAITGTSSPVGSKQPYMTITSGAISSEKQANTLLAKLKQETGVSGAVKMSGTAQFYMNVVTSEIAEETKVKELIQGLTKKTGIKSTYQPVTHEVSVTSIQSGDIIGDSKAAQVKNAFQKESGLKASLKETAKGQAYYTFTTASISGEANAKTLLQQLKQSTGITGSYKSINQKTTADVYNVQSAYFKGLNTVKDAISQIKKNTGVSGYYQKVGKSTSYTVNMKNLTKQQLQKVDAFFKKKKWHYTSSAVKKTATSSAYQITTAQILGEQQANKAAAFFTQKKVKATKKATGKKTENQYQLISEETTDQAKVTKGLNVLKKNKLSAAAKTVKKQTANTFKITTESLLEAAKVNEAITFFKSNQISAAIKKTGQTAGSKYRITTEAIISQKDIDRVLAFFKKNNASGTAAKTGATAYTQYKILTSQLSSKTALNNGLNYFKAQQLSANYTTKSNTLYKISLNEQFTGNSAASAASAKLKQLYGWTSSTVKIKNGPQIMKTNYNLSLRDMVQKQMKVSPQTDGAAYVSLTYINTATSTVTADVLNIRSTPAVSPTNVIGQLKKGDKVKIIGQTNGWAKINMGWRNASSDEVGQYVDPNNFSKDSKYYFQFLKLSQTAGLSVAEVNQKVLAGKGILTGKAKAFIDAATKYSINELYLISHALLETGNGTSGLANGLTYNGRTVYNMYGIGAYDSNPNYYGAKYAYEQGWFTPEAAIIGGAKFIGSSYIHNTAYNQDTLYKMRWSATAAHQYATDIGWAYKQVNRMYSLYSLLDGYTLYYDVPEYQ

SEQ ID NO: 3751 - protein, 880 aa, Bacillus sp.
MKKRLIAPMLLSAASLAFFTITGSAQAAAYTDYSIYKVEPAKTFSTESQASQAAAKLEKDTGWDASYQASGTTATYQITATGIHSEAQAKTVLSGLTKQTAITGTSSPVGSKQPYMTITSGAIPSEKQANTLLSKLKQETGVSGAVKMSGTAQFYMNVVTSEIADEMKVKELIQGLTKKTGIKSTYQPVTHEVSVTSIQSGAIIGDSKAAQVKNTFQKESGLKASLKETAKGQAYYTFTTASISGEANAKTLLQQLKQSTGITGSYKSINQKTTADVYNVQSAYFKGLNTVKDAISQIKKNTGVSGYYQKVGKSTSYTVNMKNLTKQQLQKVDAFFKKKKWHYTSSAVRKTATSSAYQITTAQILGKQQANKAANFFTQKKVKATKKATGKKAENQYQLISEETTDQAKVTKGLNVLKKYKLSAAAKTVKKQTANTFKITTESLLDAAKVNEAITFFKSNQISAASKKTGQTAGSKYQITTEAIISQEDIDRVLAFFKKNNVSGTAAKTGATAYTQYKILTSQLSSKTALNNGLKYFKAQQLSANYTTKSNTLYKISLNEQFTGNSAASAASAKLKQLYGWTSSTVKIKNGPQIMKTNYNLSLRDMVQKQMKVSPQTDGAAYVSLAYINTATSTVTADVLNIRSTPAVSPTNVIGQLKKGDKVKIIGQTNGWAKINMGWRNASSDEVGQYVDPNNFSMDSKYYFQFLKLSQTAGLSVAEVNQKVLTGKGILTGKAKAFIDAATKYNINELYLISHALLETGNGTSDLANGLTYNGRTVYNMYGIGAYDSNPNYYGAKYAYEQGWFTPEAAIIGGAKFIGSSYIHNTAYNQDTLYKMRWSATAAHQYATDIGWAYKQVNRMYSLYSLLDGYTLYYDVPEYQ

SEQ ID NO: 3752 - protein, 880 aa, Bacillus sp.
MKKRLIAPMLLSAASLAFFTITGSAQAAAYTDYSIYKVEPGKTFSTESQASQAAAKLEKDTGWDASYQASGTTATYQITATGIHSEAEAKTLLSGLTKQTAITGTSSPVGSKQPYMTVTSSAISSEKQANILLAKLKQETGVTGAVKMSGTAQFYMNVVTSEIADEKKVKELIQGLSKKTGIKSTYQPVTHEVSVTSIQSGAMIGDSKAAQVKNAFQKESGLKASLKETVKGQAYYTFTTAPISGEANAKTLLQQLKQSTGITGSYKSINQKTTADVYNVQSAYFKGLNTVKDAVSQIKKNTGVSGYYQKVGKSTSYTVNMKNLTKQQLQKVNAFFKKKKWHYTSSAVKKTTTSSAYQITTAQILGEQKANKAAAFFTQKKVKATKKATGKTTENQYQLISEETTDQTKVTKGLNVLKKNKLSATAKTVKKQIANTFKITTESLLEAAKVNEAITFFKSNQISAASKKTGQTTGSKYQITTEAIINKEDIDRVLAFLKKNNASGTAAKTGATAYTQYKILTSQLSSKTALNNGLNYFKAQQLSANYTTKSNTLYKISLNEQFTGNSAALAASAKLKQLYGWTSSIVKIKNGPQIMKTNYNLSLRDMVQKQMKVSPQTDGAAYVSLTYINTATSTVTADVLNIRSTPAVSPTNVIGQLKKGDKVRIIGQTNGWAKINMGWRNASSDEVGQYVDPNNFSMDSKYYFQFLKLSQTAGLSVAEVNQKVLAGKGILTGKAKAFIDAANKYSINELYLISHALLETGNGTSVLANGLTYNGKTVYNMYGIGAYDSNPNYYGAKYAYEQGWFTPEAAIIGGAKFIGTSYIHNTAYNQDTLYKMRWSATAAHQYATDIGWAYKQVNRMYSLYSLLDGYTLYYDVPEYQ

SEQ ID NO: 3753 - protein, 880 aa, Bacillus sp.
MKKRLIAPMLLSAASLAFFAISGSAQAAAYTDYSIYKVEPAKTFSTESQASQAVAKLEKDTGWDASYQASSTTTTYQISAAGIQSEAEAKAILSGLNKQTAITGTSSPVGSKQPYVTITSGAISGEKQANTLLTKLKQETGVAGAVKASGTAQSYVNVTTSEIADETKVKALIQSLAKQTGIKSSYQPITHTVSVTAIQSGTIVGDSKAEQIKSAFQKESGLKASLKATVKGQAYYTFTTAAILGEANAKNLLNQLKQSTGITGSYKSINQKATAESYNVQSAYFKGLNTVKDAISQIKKNTGVSGSYQKVGKSTSYTVNMKGLTKQQLQKVDTFFKKKKWHYTSSSVKKTTTSAAYQITTAKILGEQQANKAAAFFAQKKVKATKTAAGTTAENQYQLISEETSDQAKVTKGLNVLKKNQLSASAKSVKKQLANTFKITTESLLDTTKVNQALTFFKSNHISAASQKTGQTAASSYKIMTEAIISQKDIDRVLAFFKQNNAAGTTAKTGETAYTQYKIVTAQLSSKTALNNGLTYLKAQSVSPSYTTKTNTLYKVSLNEQFTGNDAAAAASSKLKQLYGWASSIVKIKNGPQIMKTNYNLSLRDMVQKQMTVSPQTDGAAYVSLTYINTATSTVTADVLNIRSTPAVSPTNVIDQFKKGDKVKIIGQTNGWAKINLGWRNASSDEVVQYVDPNNFSRDSKYYFQFLKLSQTAGLSVTEVNQKVLASKGILTGKAKAFIDAANKYGINELYLISHALLETGNGTSDLANGLTYNGKTVYNMYGIGAYDSNPNYYGAKYAYEQGWFTPEAAIIGGAKFIGSSYIHNTAYNQDTLYKMRWSATATHQYATDIGWAYKQVNRMYSLYSLLDGYTLYFDVPEYQ

SEQ ID NO: 3754 - protein, 880 aa, Bacillus sp.
MKKRLIAPMLLSAASLAFFAITGSAQAAAYTDYSIYEVEPSKTFSSESQASQAVAKLEKDTGWDASYQASGTTTTYQISAAGIQSEAEAKAILSGLTKQTAITGTSSPVGSKQPYVTITSGAISGDKQANTILAKLKQETGVGGAVKASGTAQSYVNVTTPEIADETKVKALIQGLVKQTGIKSTYQPITHTMSVTTIQSSTIVGDSKAEQIKNAFQKETGLKASLKATVKGQAFYTFTTAAISGEANAKNLVNQLKQSTGITGSYKSINQKNTVESYNVQSAYFKGLNTVKDAISQIKKNTGVSGSYQKVGKSNSYTVNMKGLTKQQLQKVDTFFKKKKWHYTPSSVKKTTTFTAYQMTTAKILGEQQANKAAAFFTQKKVKATKTAAGTSAENQYQLISEETSDQAKVTKGLNVLKKNQLSASAKSVKKQIANTFKITTESLLDTVKVNQALTFFQSNHISAASQKTGQTAASSYKIVTEAIISQEDIDRVLAFFKQNNAAGTTAKTGETAYTQYKIVTAQLSSKTTLNNGLTYLKAQSLSPSYTTKSNTLYQISLNEQFTGNDAASAASAKLKQLYGWTSSIVKIKNGPQIMKTNYNLSLRDMVQKQMTVSPQTDGAAYVSLTYINTATSTVTADVLNIRSTPAVSPTNVIGQFKKGDKVKIIGQTNGWAKINLGWRNASSDEVVQYVNPNNFSRDSKYYFQFLKLSQTAGLNAAEVNQKVLTGKGILTGKAKAFIDAANKYGINELYLISHALLETGNGTSDLANGLTYNGKTVYNMYGIGAYDSNPNYYGAKYAYEQSWFTPEAAIIGGAKFIGSSYIHNTAYNQDTLYKMRWSPTATHQYATDIGWAYKQVNRMYSLYSLLDGYTLYFDVPEYQ

SEQ ID NO: 3755 - protein, 880 aa, Bacillus sp.
MKKRLIAPMLLSAASLAFFAMSGSAQAAAYTDYSIYKVEPSNTFSTESQASQAVAKLEKDTGWDASYQASGTTTTYQISASGIHSDSEAKAILSGLTKQTSITGKSSPVGSKQPYVTISSGAISGEKQANTILAKLKQETGVAGAVKAYGAPQPYMNVMTSDIADETKVKALIQSLAKQTGIKSSYQPITHSVSVTTIQSGTIVGDSRAAQIKSAFQKESGLQASLKETVKGHAYYTFTTAAISGEANAKTLLQQLKQSTGITGSYKSINQKTTVESYNVQSAYFKGLNTVKDAISQIKKNTGVSGSYQQVGKSTSYTVNMKGITKQQLQKVDTFFKKKKWHYTSSSVKKTTTSAAYQITTAKILGEQQANKAAAFFAQKKVKATKTTAGTTAENQYQLISEETSDQSKVTKGLNILKQNQLSASAKSVKKQIADTFKITTESLLDQTKVNQALTFFKSNHISAASQKTGQSAASSYQITTEAIISQEDIDRVLAFFKQNNTSGTTAKTSETAYTQYKIVTAQLSSKTALNNGLTYLKSQGLTPSYTTKSNTLYKISVNEQFTGNDTAAAASSKLKQLYGWASSIVKVKNGPQIMKTNYNLSLRDMVQKQMTVSPQTDGAAYVSLTYINTATSTVTADALNIRSTPEVSPTNVIGQFKKGDKVKIIGQTNGWAKINLGWRNASSDEVVQYVDPNNFSRDSKYYFQFLKLSQTAGLNATEVNQKVLAGKGILTGKAKAFIDAANQYGINELYLISHALLETGNGTSDLANGLTYNGKTVYNMYGIGAYDSNPNYYGAKYAYEQGWFTPEAAIIGGAKFIGSSYIHNTAYNQDTLYKMRWSATATHQYATDIGWAYKQVNRMYSLYSLLDGYTLYFDVPEYQ

SEQ ID NO: 3756 - protein, 872 aa, Bacillus sp.
MLLSAASLAFFAISGSAQAAAYTDYSLYQVEPSNTFSTESQASQAVAKLEKDTGWDASYQASGTTTTYQISASGIHSESEAKAILSGLAKQTSITGTSSPVGSKQPYVTISSGAISGEKQANTVLAKLKQETGVAGAVKAYGAAQPYMNVMTSDIADETKVKALIQNLAKQTGIKSSYQPITHTVSVTTIRSGTIVGDSRAAQIKKAFQKESGLKASLKETVKGQAYYTFTTAAISGEANAKTLLQQLKQSTGITGSYKSINQKTTVESYNVQSAYFKGLNTVKDAISQIKKNTGVSGSYQQVGKSTSYTVNMKGITKQQLQKVDTFFKKKKWHYTSSSVKKTTTSAAYQITTAKMLGEQQANKAAAFFAQKKVKATKTAAGSTAENQYQLISEETSDQAKVTKGLNILKKNQLSASAKSVKKQIADTFKITTESLFDQTKVNQALTFFKSNHISAASQKTGQTAASSYQITTEAIISQEEIDRVLTFFKQNHIAVTTSKTGQTAYTQYKIVTTQLSSKTALNNGLTYLKSKSVTPSYTTKSNTLYKISVNEQFTGNDTAAAASTKLKQLYGWTSSIVKIKNGPQIMKTNYNLSLRDMVQKQMTVSPQTDGAAYVSLTYINTATSTVTADVLNIRSTPEVSPTNVIGQFKKGDKVKIIGQINGWAKINLGWRNASSDEVVQYVDPNNFTRDSKYYFQFLKLSQTAGLSVTEVNQKVLAGKGILTGRAKAFIDAANQYSINELYLISHALLETGNGTSALANGLTYNGKKVYNMYGIGAYDSNPNYYGAKYAYEQGWFTPEAAIIGGAKFIGSSYIHNTAYNQDTLYKMRWSATATHQYATDIGWAYKQVNRMYSLYSLLDGYTLYFDVPEYR

SEQ ID NO: 3757 - protein, 880 aa, Bacillus sp.
MKKSLIAPMLLSAASLVFFSISGSARAAAYTDYSIYEIEPSKTFSTESKASQAVAKLEKDTGWDASYQASGTTRTYQISAAGIHSESEAKTILSGLTKQTAITGTTSPVGSKQPYVTITSGAISGEKQANNLLAKLKQETGVAGAVKASGAAQPYVNVMTSEIADETKAKALIQSMAKQTGIKSSYQPITHTVSVTTIQSGTIVGNSKAEQIKSAFQKESGLQASLKETVKGQAYYTFTTAAISREANAKNLLNQLKQSTGITGSYRSIKQKTTAESYNVQSAYFKGLNTVKDAISQIKKNTGVSGSYQQIGKSSSYTVSMKGLTKQKLQKIDTFFKKKKWHYTSSSVKKTTASTAYQITTAQILGERQSNKAAAFFSQKKVKATKKATGTTAENQYQLISEETSDQAKVTKGLNMLKKNQLSAAAKTVNKQMPNTFKISTESLLDTAKVNQALTFFQSNHISATSQKTGQTTASSYQIITGAIISQEDIDRVLAFFKQNNAAGTTAKTGETAYTQYKIVTAQLSSKTALNNGLTYLKTQSLIPSYTTKSNTLYKISINDQFTGNNAAAAASTKLKQLYGWTSSIVKIKNGPQIMKTNYNLSLRDLVQKQMTVSPQTDGAAYISLNYINTATSTVTADALNIRSTPAVIPTNVIGQFKKGDKVKMISQTNGWAKINLGWRNASSDEVVQYVDPNNFSRDSKYYFQFLKLSQTAGLSMTEVNQKVLAGKGILTGKAKAFIDAAKQYGINELYLISHALLETGNGTSDLANGLTYNGKKVYNMYGIGAYDSNPNEYGAKYAYEQGWFTPEAAIIGGAKFIGSSYIHNTAYNQDTLYKMRWSATATHQYATDIGWAYKQVNRMYSLYSLLDGYTLYFDVPEYQ

SEQ ID NO: 3758 - protein, 880 aa, Bacillus sp.
MKKKFFASMSLSAAALVFFTIASSAQAAYIDNSIYKIEPAKHFASESEASQAVSKLKKDTGWQAFYKASGSSSAAYQISASGINSEAAAKSALGQLTKQTGITGTYSPAGSKQPYVTITSGAIAGEQPANSLLAKLKKETGITGAVKATGVKQNYINVVTSEIEGETKVKGIAQGLAKETGVKSTYQPVKNEKSLTRIQSGIIQGDGKAAQMKTAFQKETGLTASLKETSKGEIYYTLTTADFSGESNAKNLVKQLEQSTGIKGSYKAISQKKTVSAYNVQSGYFKGLSTVKNAISQIKKNTGVSGIYQKVGKSTSYTVNMKGISKQELQKVQAFFKKKKWRYTSASAKTTTSATVYQITTAPVLGEQLANKGTAFFTQKKVKTSRKSTGKKTENQYRLVSEETSDQGKITKGLSFLKKNNLSATTQIIKKQTNSQFKITTESLLDTTKINQTLAYFKGKSIPASSQKTGKTTNSQYQITTAELLNQQDIDRVLAFFKQNKASGSKTPTGKTAYTQYKIVTAQLSDKTTLNKGLNYFKTNKISASYTSKSNPLYEITITQQFTGNDTASAAAAKLKKLYGWTSSIVKIKNGPQIMKTNYNVSLRDMVQKQMTVSPQTDGAAYVSLAYINTAAQTVTADVLNIRSTPAVSPTNVIGQFTKGDRVKIISQANGWAKINMNWRNASSDEVEQYVNPDNFSLDSKYYFQFLKLSQTAGLTASEVNQKVLYNKGILAGKGQSFIDAANKYGINELYLISHALLETGNGTSNLATGTTYNGKTVYNMYGIGAYDSNPLYYGAKYAYEQGWFTPQAAIIGGAKFIGSSYIHNTAYQQDTLYKMRWSPTASHQYATDIGWAYKQVNRMYSLYTLLDGYTLYYDVPVYK

SEQ ID NO: 3759 - protein, 880 aa, Bacillus sp.
MRKRFFASTSLSAAALVFFTIASSAQAAYIDNSIYKIEPAQQFASESEASQAVSKLKKDTGWQAFYKASGSSSAAYQISASGINSEAAAKSALGQLTKQTGITGTYSPAGSKQPYVTITSGAIAGEQPANSLLAKLKKETGITGAVKATGVKQNYINVVTSEIEGETKVKGIAQGLAKETGVKSTYQPVKNEKSLTRIQSGIIQGDGKAAQMKTAFQKESGLTASLKETSKGEIYYTLTTADFSGESNAKNLVKQLEQSTGIKGSYKAISQKKTVSAYNVQSGYFKGLSTVKNAISQIKKNTGVSGTYQRVGKSTSYTVNMKGISKQELQKVQAFFKKKKWRYTSASAKTTTSATVYQITTAPVLGEQLANKGTAFFTQKKVKTSRKSTGKKTENQYRLVSEETSDQGKITKGLSFLKKNNLSATTQIIKKQTNSQFKITTESLLDTTKINQTLAYFKGKSIPASSQKTGKTTNSQYQITTAELLNQHDIDRVLAFFKQNKASGSKTPTGKKAYTQYKIVTAQLSDKTTLNKGLNYFKTNKISASYTSKSNPLYEISITQQFTGNDTASAAAAKLKKLYGWTSSIVKIKNGPQIMKTNYNVSLRDMVQKQMTVSPQTDGAAYVSLAYINTAAQTVTADVLNIRSTPAVSPTNVIGQFTKGDRVKIISQANGWAKINMNWRNASSDEVEQYVNPDNFSLDSKYYFQFLKLSQTAGLTASEVNQKVLYNKGILAGKGQSFIDAANKYGINELYLISHALLETGNGTSNLATGTTYNGKTVYNMYGIGAYDSNPLYYGAKYAYEQGWFTPQAAIIGGAKFIGSSYIHNTAYQQDTLYKMRWSPTASHQYATDIGWAYKQVNRMYSLYTLLDGYTLYYDVPVYK

SEQ ID NO: 3760 - protein, 250 aa, Serratia sp.
MKIRTSLIALSITALLSGCQNLNTDTLLQSGAQAYQAATLSDSDVKALSDKSCAEMDSQEQIAPASSDYTKRLNKIAAALGDNINGTPANYKVYVTKDVNAWAMANGCIRVYSGLMDMMDDNEVEGVLGHEMGHVALGHTRKAMQVAYGTVALRTAASSAGGVAASLSQSQLADLGEKLVNAQFSQKQESEADDYSFDLLKKRGINPAGLATSFDKLAKLDGGHESSMFDSHPTSEARAKHIRDRIAAGK

SEQ ID NO: 3761 - protein, 250 aa, Serratia sp.
MKIRTSLIALSLTALLSGCQNLNTDTLLQSGAQAYQAATLSDSDVKALSDKSCAEMDSQEQIAPASSEYTKRLNKIAAALGDNINGTPANYKVYVTKDVNAWAMANGCIRVYSGLMDMMDDNEVEGVLGHEMGHVALGHTRKAMQVAYGTVALRTAASSAGGVAASLSQSQLADLGEKLVNAQFSQKQESEADDYSFDLLKKRGINPAGLATSFDKLAKLDGGHESSMFDSHPTSEARAKHIRDRIAAGK

SEQ ID NO: 3762 - protein, 250 aa, Serratia sp.
MKIRTTLIALSITALLSGCQNLNTDTLLQSGAQAYQAATLSDNDVKALSDKSCAEVDSQEQIAPASSDYTKRLNKIAAALGDNINGTPANYKVYLTKDVNAWAMANGCIRVYSGLMDMMDDNEVEGVLGHEMGHVALGHTRKAMQVAYGTVAVRTAAASAGGVAASLSQSQLADLGEKLVNAQFSQKQESDADDYSFELLKKRGINPAGLATSFDKLAKLDAGRESSMFDSHPTSEARAKHIRDRIAAGK

SEQ ID NO: 3763 - protein, 250 aa, Serratia sp.
MKIRISLIALSITALLSGCQNLNTNTLMQSGAQAFQAATLSDNDVIALSDKSCAEMDSKAQIAPANSDYAKRLNKIAAALGDNINGTPANYKVYMTNDVNAWAMANGCIRVYSGLMDMMTDNEVEGVLGHEMGHVALGHTRKKLQVAYGTVALRTAASSAGGVVGSLSQSQLADLGEKLVNAQFSQKQESEADDYSFDLLKKRGIDPNGLVTSFEKLAKMEGGRKSSMFDDHPASEARAQHIRDRIAAGK

SEQ ID NO: 3764 - protein, 250 aa, Serratia sp.
MKIRTSLIALSIATLASGCQNLNTDTLMQSGAQAFQAATLSNNDVKTLSDKSCAEMDSKAQIAPADSTYAKRLNKIAAALGDNINGTPANYKVYVTKDVNAWAMANGCIRVYSGLMDMMTDNEVEGVLGHEMGHVALGHTRKAMQVAYGTVALRTAAASTGGIIGSLSQSQLADMGEKLVNAQFSQKQESEADDYSFDLLKQRGIDPNGLVTSFEKLAKMEAGRQSSMFDDHPASEARAQHIRDRIAAGK

SEQ ID NO: 3765 - protein, 250 aa, Serratia sp.
MKIRTSLIALSIATLVSGCQNLNTDTLMQSGAQAFQAATLSNNDVKILSDKSCAEMDSKAQIAPADSTYAKRLNKIAAALGDNINGTPANYKVYVTKDVNAWAMANGCIRVYSGLMDMMTDNEVEGVLGHEMGHVALGHTRKAMQVAYGTVALRTAAASTGGIIGSLSQSQLADMGEKLVNAQFSQKQESEADDYSFDLLKQRGIDPNGLVSSFEKLAKMEAGRQSSMFDDHPASEARAQHIRERIAAGK

SEQ ID NO: 3766 - protein, 250 aa, Serratia sp.
MKIRTSLIALSITTLLSGCQNLNTDTLMQSGAQAYQAATLSDADVKALSDKSCAEMDSQSQIAPANSTYTQRLNKIAAALGDNINGTTANYKVYLTKDVNAWAMANGCIRVYSGLMDLMNDNEVEGVLGHEIGHVALGHSRKAMQVAYSTVAVRTAAASAGGIVGSLSESQLADLGEKLVNAQFSQKQETEADDYSFDLLKKRGIDPNGLVTSFEKLAQMEGSRKSSMFDGHPPSEARAQHIRERIAAGK

SEQ ID NO: 3767 - protein, 250 aa, Yersinia sp.
MKIRTSMIALSLTALLSGCQNMSADGLMQSGAQAFQAATLSDADVKTLSDKSCVEMDQKAQIAPADSTYAKRLAKISAALGDNINGTPANYKVYVTKDVNAWAMANGCIRVYSGLMDMMTDNEVEGVLGHEMGHVALGHTRKAMQVAYGTTALRTAAASAGGVTSQLSQSQLADIGEKLVNAQFSQKQESEADDYSFDLLKKRGIDPNGLVTSFEKLATMEAGRSSSMFDDHPSSQARADHIRQRIAAGK

SEQ ID NO: 3768 - protein, 250 aa, Yersinia sp.
MKIRTSMIALSLTVFLSGCQNMNTDGLMQSGAQAFQAATLSDADVKNLSEKSCAEMDQKAQIASANSDYGKRLAKISAALGDNINGTPANYKVYVTKDVNAWAMANGCIRVYSGLMDMMTDNEVEGVLGHEMGHVALGHTRKAMQVAYGTTALRTAAASAGGIAGQLSQSQLADIGEKLVSAQFSQKQESEADDYSFDLLKKRGIDPNGLVTSFEKLATMEAGRTSSMFDDHPSSQARADHIRQRIAAEK

SEQ ID NO: 3769 - protein, 250 aa, Pantoea sp.
MKLSLSLTALTLTAALSGCANLNTDALMQSGAQAYQAATLSDAQVKELSVTSCAQMDSEAQIAPASSVYAQRLDKIAKALGDNINGTPANYKVYVTKDVNAWAMANGCIRVYSGLMDIMTDNEVEGVLGHEMGHVALGHTRKAMQVAYGTTAARTAVGSVGGVAASLSQSQLADMGEKLVNAQFSQTQESQADDYSFDLLKKRGISPQGLVTSFEKLAKLEGSHQSSMFDSHPSSESRAQHIKERIAAGK

SEQ ID NO: 3770 - protein, 250 aa, Yersinia sp.
MKIRTSMIVLSLTALLSGCQNMNTDGLMQSGAQAFQAATLSDADVKNFSEQSCAEMDQKAQIASADSDYGKRLAKISAALGDNINGTPANYKVYVTKDVNAWAMANGCIRVYSGLMDMMTDNEVEAVLGHEMGHVALGHTRKAMQVAYGTTALRTAAASAGGIAGQLSQSQLADIGQKLVNAQFSQKQESEADDYSFELLKKQGIDPNGLVTSFEKLATMEAGRTSSMFDDHPSSQARADHIRQRIASGQ

SEQ ID NO: 3771 - protein, 250 aa, Pectobacterium sp.
MAIRSSVLALCIATLLTGCQNLNTNTLMQSGAQAFQAATLSDADVKALSNQSCEQMDKEAKIAPADSKYTQRLNKIADALGHDINGTPANYKVYLTKDVNAWAMANGCIRVYSGLMDMMNDNEVEGVLGHEIGHVALGHTRKAMQVAYAATAARTAIGSAGGVAASLSQSQLADLGEKLVNSQFSQTQETQADDYSFDLLKKRGVKLEGLASSFEKLAKLDAGRESSMFDSHPSSEGRAKHIRERIAAEK

SEQ ID NO: 3772 - protein, 250 aa, Pectobacterium sp.
MAIRSSVLALCVATLLTGCQNLNTNTLMQSGAQAFQAATLSDADVKSLSNQSCEQMDKEAKIAPADSKYTQRLNKIADALGHDINGTPANYKVYLTKDVNAWAMANGCIRVYSGLMDMMNDNEVEGVLGHEIGHVALGHTRKAMQVAYAATAARTAIGSAGGVAASLSQSQLADLGEKLVNSQFSQTQETQADDYSFDLLKKRGVKLEGLASSFEKLAKLDAGRESSMFDSHPSSEGRAKHIRERIAAEK

SEQ ID NO: 3773 - protein, 250 aa, Erwinia sp.
MKKRITCIALALTGLLSGCQNFDSNALMQSGSQAWQAATLSDAQVKELSDKSCQQMDSEAQIAPDSSPYAQRLKKISAALGDNINGTPANYKVYLTKDVNAWAMANGCIRVYSGLMDLMSDNEVEGVLGHEMGHVALGHSRKAMQLAWATTAVRSAAASVGGVTASLSQSQLGDLGEKLVNAQFSQGQESQADDYSFDLLKKRNINPQGLVTSFDKLAKLEGTHASSMFDSHPSSQARADHIKQRIAAGK

SEQ ID NO: 3774 - protein, 251 aa, unknown
  environmental sample
MKIKKMVLALGLTTLLSGCQGLDNNALMQSGAQAYQAYTLSDDQVKQLSDKSCEQMDKDNQIAPANSDYQQRLNKIAAALGDNINGVPANYKVYQTKDVNAWAMANGCIRVYSGLMDMMTDNEVEGVLGHEMGHVALGHTRKAMQLAYATTAARTAAASVGGVIGSLSQSQLGEMGEKLVNAQFSQTQESQADDYSYDLMKKRNIDPMGLATSFEKLAKMEQGRQSSMFDSHPASEARAAHIRERIAADGK

SEQ ID NO: 3775 - protein, 250 aa, Pantoea sp.
MKMRATIVALGMASLLSGCEGFDNNALLQSGAQAYQAYALNDAQVKELSDQSCAQMDKDNQVAPANSEYQQRLNKIAAALGDNINGVPANYKVYQTKDVNAWAMANGCIRVYSGLMDMMTDNEVEGVLGHEMGHVALGHTRKAMQVALTTTATRTAAASVGGVIGSLSQSQLGEMGEKLVNAQFSQTQETQADDYSFDLMKKRGIDPMGLATSFEKLAKLEQGRQSSMFDSHPDSEARAQHIRERIAAGK

SEQ ID NO: 3776 - protein, 251 aa, Pantoea sp.
MKMTQLAATLGVTLLLAGCQNFDSNALMQSGAQAFQAVTLNDQQVKTLSDQSCQKMDSENKVADANDPYQQRLNKIAAALGDNINGTPANYKVYLTKDVNAWAMANGCIRVYSGLMDLMSDNEVTAVVGHEMGHVALGHTRKAMQVAYGTTAARTAAASAGGIAATLSQSQLGEMGEKLVNAQFSQSQESQADDYSFDLLKKRGISQEGLVTSFEKLAKLEGAQQSSSMFDSHPSSSARAEHIRQRIAAGK

SEQ ID NO: 3777 - protein, 252 aa, Buttiauxella sp.
MKLRPILLSLSVAALLSGCQNMDSNGLLASGAEAFQAYTLSDAQVKELSDKSCAELDSKASIAPASSEYAQRLSKISAALGDNINGMPVNYKVYVTKDVNAFAMANGCIRVYSGLMDMMNDNEVEAVIGHEMGHVALGHVKKGMQVALGTNAARVAAASAGGVIGSLSQSQLGDLGEKLVNAQFSQRQESEADDYSYDLLRKRGINPIGLATSFEKLAKEEEGRQSSMLDDHPASAERAQHIRDRMAADGLK

SEQ ID NO: 3778 - protein, 252 aa, Salmonella sp.
MKIRALLLALGMATVLTGCQNMDSNGLLSSGAEAFQAYTLSDAQVKALSDQSCQELDSKAKIAPASSEYAKRLAKIAAALGDNINGQPVNYKVYETKDVNAFAMANGCIRVYSGLMDMMTDNEVEAVIGHEMGHVALGHVKKGMQVALGTNAVRVAAASAGGVVGSLSQSQLGDLGEKLVNSQFSQRQESEADDYSYDLLRKRGISPAGLATSFEKLAKLEAGRQSSMFDDHPASAARAQHVRDRMSADGIK

SEQ ID NO: 3779 - protein, 249 aa, Proteus sp.
MKIKLLATVMVSAALLSGCKNLNTDMLTKSGTQLFQAATLSDDDIKALTNDACKEMDAQNKVAPANSTYTKRLNNIAKALGNEVNGTPVNYKVYMTKDVNAWAMANGCVRVYSGLMDMMTDNEVEGVLGHEMGHVALGHTRKAIQVAHATVAARTAAASAGGVAAQLSSSQLAEMGEKLVNAQFSQHQESEADNFSYDLLKKRGVSTAGLVTGFEKLAKLGGGDSSMFDSHPPSKERADNIRNRIAADK

SEQ ID NO: 3780 - protein, 252 aa, Enterobacter.2 sp.
MKMRAIVLALGTTLLLSGCQNMDSNGLMTSGAEAFQAYSLSDAQVKALSDQACKDMDGKATLAPANSTYTQRLNKIASALGDNINGQPVNYKVYMAKDVNAFAMANGCIRVYSGLMDMMTDNEVEAVIGHEMGHVALGHVKKGMQVALGTNAIRAAAASAGGIVGSLSQSQLGDVGEKLVNSQFSQRQESEADDYSYDLLRKRGINPSGLATSFEKLAKLEAGRQSSMFDDHPASEERAQHIRDRMAADGIK

SEQ ID NO: 3781 - protein, 252 aa, unknown
  environmental sample
MKMRAIVLALGTTLLLSGCQNMDSNGLMSSGAEAFQAYSLSDAQVKALSDQACKDMDGKATLAPANSTYTQRLNKIASALGDNINGQPVNYKVYMAKDVNAFAMANGCIRVYSGLMDMMTDNEVEAVIGHEMGHVALGHVKKGMQVALGTNAIRAAAASTGGIVGSLSQSQLGDVGEKLVNSQFSQRQESEADDYSYVLLRKRGINPSGLATSFEKLAKLEAGRQSSMFDDHPASEERAQHIRDRMAADGIK

SEQ ID NO: 3782 - protein, 887 aa, Serratia sp.
MNKFKMSALAALTATVGLFGSVGSAMANQQVVDQLSQLQVNLKMLDNRAAEHGVDCAKLGADWASCHKVLITLTNGNQEIKDKDWAIYFHSPRQTLKVDNDQFKITHITGDLYKLEPTDKFTSFPANQAVEIPIIAEYWQLFRTDFLPRWYATSGDAQPKILSNTDTDDINQFVAPFTGDQWKRTKDDNNILMVPESRFTKNQDLKVLPMASLRGQIIPTPMEVKVHAKDIDLSKGVALDLSALTKPAADAAAERFALLGIESQASGYPIKTDIKPAAFKGDQAVPGAYQLKIGEKGAEIVGFDQTGVFYGLQSILSLIPSDGSKKIATLDAKDAPRFQYRGIFLDVARNFHHKDAVLRLLDQMAAYKLNKFHFHLTDDEGWRIEIPGLPELTEVGGQRCHDLSETTCLMPQYGSGPAPHGGFFSRQDYIDIVKYAQARQIEVIPEIDMPAHARAAIISMEARYKKLLAEGKEKEANQFRLVDPTDTSNTTSVQYFNRQSYLNPCLDSSKNFVDKVIGEVAQMHKEAGQPLKTWHFGGDEAKNIRLGAGYTDVKNPEAGKGILDLSKEDKPWAKSQVCQAIIKDGKVEDMEHLPSYFGLEVSQLVKAHGIDRMQAWQDGLKDAKDSKAFATKHVAVNFWDTLYWGGFDSANDWANKGYDVVISNPDYVYMDFPYEVSPDEHGYYWGTRFSDEQKIFSFAPNNLPQNAETSVDRDGNHFTAKSDKPWPGAYGLSAQLWSEVVRTDQQMEYMIYPRAVSLAERAWHRASWEQDYKAGREYKGGETHQVDTKTLDQDWLRFANLIGQRELAKMDKAGVSYRLPVPGARIIGGKLEANIALPGLGIEYSTDGGKQWQRYDDKARPAVAGEVQIRAISPDGKRFSRAEPVKA

SEQ ID NO: 3783 - protein, 887 aa, Serratia sp.
MNKFKMSALAALTATVGLLGSVGSAMANQQVVDQLSQLQVNLKMLDNRAAEHGVDCAKLGADWASCHKVLITLTNGSQEIKDKDWAIYFHSPRQTLKVDNDQFKITHLTGDLYKLEPTDKFTSFPANQAVEIPIIAEYWQLFRTDFLPRWYATSGDAQPKILSNTDTEDVNQFVAPFTGDQWKRTKDDNNILMVPESRFTKNQDLKVLPAATLRGQIIPTPMEVKVHSQDVDLSKGVALELSALTKPAADAAAERFALLGIKNQAGGYPIKTDIKPAAFKGDLAVPGAYQLKIGEKGAEIVGFDQTGVFYGLQSILSLIPSDGSMKIATLDAKDAPRFQYRGIFLDVARNFHHKDAVLRLLDQMAAYKLNKFHFHLTDDEGWRIEIPGLPELTEVGGQRCHDLSETTCLMPQYGSGPAPHGGFFSRQDYIDIVKYAQARQIEVIPEIDMPAHARAAIVSMEARYKKLLAEGKEKEANQFRLVDPTDTSNTTSVQYFNRQSYLNPCLDSSKNFVDKVIGEVAQMHKEAGQPLQTWHFGGDEAKNIRLGAGYTDVKNPEAGKGILDLSKEDKPWAKSQVCQAFIKDGKVADMEHLPSYFGLEVSQLVKAHGIDRMQAWQNGLKDAKDSQAFATKHVAVNFWDTLYWGGFDSANDWANKGYDVVISNPDYVYMDFPYEVSPDEHGYYWGTRFSDEQKIFSFAPNNLPQNAETSVDRDGNHFTAKSDKPWPGAYGLSAQLWSEVVRTDQQMEYMIYPRAISVAERAWHRASWEQDYKAGREYKGGETHQVDTKTLDQDWLRFANLIGQRELAKMDKAGVSYRLPVPGARIVGGKLEANISLPGLGIEYSTDGGKQWQRYDDKARPAVAGDVQIRAISPDGKRFSRAEPVRA

SEQ ID NO: 3784 - protein, 887 aa, Serratia sp.
MNKFKMSALAALTATVGLFGSAGSAMANQQVVDQLSQLKVNLKMQDNRAGEHGVDCAKLGADWASCHKVLITLTNGGQEIKDKDWAIYFHSPRQTLKVDNDQFKITHLTGDLYKLEPTDKFTSFPANQAVEIPIIAEYWQLFRTDFLPRWYATSGDAKPKILANTDTEDVNQFVAPFTGDQWKRTKDDNNVLMVPESRFAKNQELKVLPMATLRGQIIPTPMDVKIHQQDVDLSKGVALELSALTKPAADAAAKRFELLGVENKADGYPIKTDIQPGAFKGDLAVPGAYQLKIGEKGAVITGFDQAGVFYGLQSILSLIPTDGSKKIATLDAKDAPRFQYRGIFLDVARNFHHKDAVLRLLDQMAAYKLNKFHFHLTDDEGWRIEIPGLPELTEVGGQRCHDLSETTCLLPQYGSGPQPHGGFFSRQDYIDIVKYAQARQIEVIPEIDMPAHARAAIISMEARYKKLHAEGKEKEANEFRLVDPTDTSNTTSVQYFNRQSYLNPCLDSSKSFVDKVIGEIAQMHKEAGQPLQTWHFGGDEAKNIRLGAGYTDVKKPEPGKGILDLSKEDKPWAKSQVCQAMIKDGKVEDMEHLPSYFGLEVSQLVKAHGIDKMQAWQDGLKDAKDSQAFATKNVAVNFWDTLYWGGFDSANDWANKGYQVVISNPDYVYMDFPYEVSPDEHGYYWGTRFSDEQKIFSFAPNNLPQNAETSVDRDGNHFTAKSDKPWPGAYGLSAQLWSEIVRTDQQMEYMIYPRALSVAERAWHRASWEQDYKAGREYKGGETHQVDTQTLDKDWLRFANLIGQRELAKLDKAGVSYRLPVPGARIIGGKLEANISLPGLGIEYSTDGGKQWQRYDDKARPAVAGDVQIRAISPDGKRFSRAEPVKA

SEQ ID NO: 3785 - protein, 887 aa, Serratia sp.
MNKFKMSALAALTATVGLFGGVGSAMANQQIVDQLSQLNVKLQMQDNRAADHGVDCAKLGADWASCNKVLITLTNSGQEIKGQDWAIYFHSPRQTLKVDNEQFKITHITGDLYKLEPTDKFTSFPANQAVEIPIIAEYWQVFHSDFLPRWYATSGDAKPKILANTDTEDVNQFVAPFTGDQWKRTKDDNNILMVPESRFIKNQDLKVLPTAALRGQIVPTPMEVKVHQHDVDLSKGVALELSALAKPAADAAAKRFELLGVANQAGGYPIKTDIQPGAFKGDLAVSGAYQLKVGEKGALVTGFDQAGVFYGLQSILSLIPSDGSKKIATLDATDAPRFQYRGMFLDVARNFHQKDAVLRLLDQMAAYKLNKFHFHLTDDEGWRIEIPGLPELTEVGGQRCHDLSETTCLLPQYGSGPEPHGGFFSRQDYIDIVKYAQARQIEVIPEIDMPAHARAAIVSMEARYKKLHAAGKEKEANEFRLVDPTDTSNTTSVQYFDRQSYLNPCLDSSKNFVDKVIGEVAQMHKEAGQPLKTWHFGGDEAKNIRLGAGYTDVKKPEAGKGILDLSKEDKPWAKSQVCQAIIKDGKVEDMEHLPSYFGLEVSQLVKAHGIDRMQAWQDGLKDAKDSKAFATKNVAVNFWDTLYWGGFDSVNDWANKGYDVVISNPDYVYMDFPYEVTPKEHGYYWGTRFSDEQKIFSFAPDNLPQNAETSVDRDGNHFAAKSDKPWPGAYGLSAQLWSEVVRTDQQMEYMIYPRALSVAERAWHRASWEQDYKAGREYKGGETHHVDTKALEKDWQRFANLIGQRELAKLDKGGVSYRLPVPGARVVDGKLEANIALPGLGIEYSVDGGKQWQRYNDNARPAVAGDVQIRAISPDGKRFSRAEPVKA

SEQ ID NO: 3786 - protein, 885 aa, Serratia sp.
MNKFKLNALAALTATVGLFGGVGNAMADQQLVDQLSQLKLNLKMVDNRAADNGLDCGKLGADWAACNKVVISLTNDNQDIKGQDWAIYFHSARQTMRVDNDQFRVSHLTGDLYKLEPTDKFTGFPAGKTVEIPIIAEYWQLFKTDFVPRWYATSGDAKPKVLVNTDTEDLNQFVAPFTGDQWKRTKDDNNILMTPASRFTKNAELKTLPAASLRGQIVPTPLEVKVHPQDVDLSKGVALELSALSKPAAEAAAERFALLGVTNNAGGYPIKTDIQPGKFKGELAVPGAYELKIGNKEARVIGFDQAGVFYGLQSILSLVPTDGSANIATLDAKDAPRFQYRGIFLDVARNFHQKDAVLRLLDQMAAYKLNKFHFHLSDDEGWRIEIPGLPELIEVGGQRCHDLSETTCLLPQYGQGPDVYGGFFSRQDYIDIIKYAQARQIEVIPEIDMPAHARAAVVSMEARYKKLHAAGKEKEADEFRLVDPTDTSNTTSVQYFNRQSYLNPCLDSSKRFVDKVIGEIAQMHKEAGQPLRTWHFGGDEAKNIRLGAGYTNLTKPEAGKGIIDQSKEDKPWARSQVCQAMIKEGKVADMEHLPSYFGLEVSQQVKAHGIDRMQAWQDGLKDAKDAKAFATQRVGVNFWDTLYWGGFDSANDWANKGYEVILSNPDYVYMDFPYEVNPDERGYYWGTRFSDERKMFSFAPNNLPQNAETSVDRDGNHFTAKSDKPWPGAYGISAQMWSETQRTDPQMEYMIFPRSLSVAERAWHRAGWEQDYRAGREYKGGETHFVDGKQLDRDWLRFANILGQRELAKLDKGGVSYRLPVPGARVVGGKLEANISLPGLGIEYSIDGGKHWQRYDGKAKPAVAGDVQIRAVSPDGKRYSRAEKV

SEQ ID NO: 3787 - protein, 885 aa, Serratia sp.
MNKFKLNALAALTATVGLFGGVGNAMADQQLVDQLSQLKLNLKMVDNRAADSGLDCGKLGADWAACNKVVISLTNDNQDIKGQDWAIYFHSARQTMRVDNDQFRVSHLTGDLYKLEPTDKFTGFPAGKTVEIPIIAEYWQLFKTDFVPRWYATSGDAKPKVLVNTDTEDLNQFVAPFTGDQWKRTKDDNNILMTPASRFTKNAELKTLPAASLRGQIVPTPLEVKVHPQDVDLSKGVALELSALSKPAAEAAAERFALLGVTNNAGGYPIKTDIQPGKFKGELAVPGAYELKIGNKEARVIGFDQAGVFYGLQSILSLVPTDGSANIATLDAKDAPRFQYRGIFLDVARNFHQKDAVLRLLDQMAAYKLNKFHFHLSDDEGWRIEIPGLPELIEVGGQRCHDLSETTCLLPQYGQGPDVYGGFFSRQDYIDIIKYAQARQIEVIPEIDMPAHARAAVVSMEARYKKLHAAGKEKEADEFRLVDPTDTSNTTSVQYFNRQSYLNPCLDSSKRFVDKVIGEIAQMHKEAGQPLRTWHFGGDEAKNIRLGAGYTNLTKPEAGKGIIDQSKEDKPWARSQVCQAMIKEGNVADMEHLPSYFGLEVSQQVKAHGIDRMQAWQDGLKDAKDAKAFATQRVGVNFWDTLYWGGFDSANDWANKGYEVILSNPDYVYMDFPYEVNPDERGYYWGTRFSDERKMFSFAPNNLPQNAETSVDRDGNHFTAKSDKPWPGAYGISAQMWSETQRTDPQMEYMIFPRSLSVAERAWHRAGWEQDYRAGREYKGGETHFVDGKQLDRDWLRFANILGQRELAKLDKGGVSYRLPVPGARVVGGKLEANISLPGLGIEYSIDGGKHWQRYDGKAKPAVAGDVQIRAVSPDGKRYSRAEKV

SEQ ID NO: 3788 - protein, 885 aa, Serratia sp.
MNAFKLSALAALTATMGFLGGMGSAMADQQLVDQLSQLKLNVKMLDNRAGENGVDCAALGADWASCNRVLFTLSNDGQAIDGKDWIIYFHSPRQTLRVDNDQFKIAHLTGDLYKLEPTAKFSGFPAGKAVEIPVVAEYWQLFRNDFLPRWYATSGDAKPKMLANTDTENLDQFVAPFTGDQWKRTKDDKNILMTPASRFVSNADLQTLPAGALRGQIVPTPMQVKVHAQDADLRKGVSPDLSALVKPAADVVNQRFALLGVPVQANGYPIKTDIQPGKFKGAMAVPGAYELKIGKKEARVIGFDQAGVFYGLQSILSLVPTDGSGKIATLDASDAPRFQYRGIFLDVARNFHKKDAVLRLLDQMAAYKLNKFHFHLSDDEGWRIEIPGLPELTEVGGQRCHDLSETTCLLPQYGQGPDVYGGFFTRQDYIDIIKYAQARQIEVIPEIDMPAHARAAVVSMEARYKKLHAAGKEQEANEFRLVDPTDTSNTTSVQFFNRQSYLNPCLDSSQRFVDKVIGEIAQMHKEAGQPIKTWHFGGDEAKNIRLGAGYTDKAKPEPGKGIIDQSNEDKPWAKSQVCQVMIKEGKVADMEHLPSYFGQEVSKLVKAHGIDRMQAWQDGLKDAESSKAFATSRVGVNFWDTLYWGGFDSVNDWANKGYEVVVSNPDYVYMDFPYEVNPDERGYYWGTRFSDERKVFSFAPDNMPQNAETSVDRDGNHFNAKSDKPWPGAYGLSAQLWSETQRTDPQMEYMIFPRALSVAERAWHRAGWEQDYRAGREYKGGETHFVDTKTLEKDWLRFANILGQRELAKLDKGGVAYRLPVPGARVAGGKLEANIALPGLGIEYSTDGGKQWQRYDAKAKPAVSGEVQVRSVSPDGKRYSRAEKV

SEQ ID NO: 3789 - protein, 885 aa, Serratia sp.
MNAFKLSALAALTATMGFLGGMGNAMADQQLVDQLSQLKLNVKMLDNRAGENGVDCAALGADWASCNRVLFTLSNDGQAIDGKDWVIYFHSPRQTLRVDNDQFKIAHLTGDLYKLEPTAKFSGFPAGKAVEIPVVAEYWQLFRNDFLPRWYATSGDAKPKMLANTDTENLDQFVAPFTGDQWKRTKDDKNILMTPASRFVSNAELQTLPAGALRGQIVPTPMQVKVHAQDADLRKGVSPDLSTLVKPAADVVNQRFALLGVPVQANGYPIKTDIQPGKFKGAMAVPGAYELKIGKKEARVIGFDQAGVFYGLQSILSLVPTDGSGKIATLDASDAPRFQYRGIFLDVARNFHKKDAVLRLLDQMAAYKLNKFHFHLSDDEGWRIEIPGLPELTEVGGQRCHDLSETTCLLPQYGQGPDVYGGFFSRQDYIDIIKYAQARQIEVIPEIDMPAHARAAVVSMEARYKKLHAAGKEQEANEFRLVDPTDTSNTTSVQFFNRQSYLNPCLDSSQRFVDKVIGEIAQMHKEAGQPIKTWHFGGDEAKNIRLGAGYTDKAKPEPGKGVIDQSNEDKPWAKSQVCQTMIKEGKVADMEHLPSYFGQEVSKLVKAHGIDRMQAWQDGLKDAESAKSFATSRVGVNFWDTLYWGGFDSVNDWANKGYEVVVSNPDYVYMDFPYEVNPDERGYYWGTRFSDERKVFSFAPDNMPQNAETSVDRDGNHFNAKSDKPWPGAYGLSAQLWSETQRTDPQMEYMIFPRALSVAERAWHRAGWEQDYRAGREYKGGETHFVDTKALEKDWLRFANILGQRELAKLDKGGVAYRLPVPGARVAGGKLEANIALPGLGIEYSTDGGKQWQRYDAKAKPAVSGEVQVRSVSPDGKRYSRAEKV

SEQ ID NO: 3790 - protein, 887 aa, Serratia sp.
MNKFKLSALAVLAATAGMFGAAGSAMADQPLVERLSQLKLNIKMLDNRAADSGVDCARLGADWAACNKVLITLANGGQAITAKDWAIYFHSPRQTLEVGNKQFRITHLTGDLYKLEPTAAFRGFPANQAVEIPIVAEYWQLFKTDFLPRWYATAGDAKPQVLVNTDTEDLDRFVAPFGDDQWKRTKDDNNVLMTPASRFTRNADVQTLPAASLRGQIIPTPMSVQIHAQDIDLGNGVALNLDALEPASAEVVRERFKQLGVASVATGYPIVTEIRPASFSGEIAQSGAYKLTLSEKEARITGFDQSGVFYGLQSILSLIPLNGEKKIAALEASDAPRFAYRGLFLDVARNFHHKDAVLRLLDQMAAYKLNKFHFHLTDDEGWRIEIPGLPELTDVGAQRCHDLSETTCLLPQYGQGPGVYGGFFSRQDYIDILKYAQARHIEVIPEIDMPAHARAAVVSMEARYQKLMAQGKQQEAEAYRLVDPTDTSNTTSVQFFNRQSYLNPCLDSSTRFVDKVMGELVKMHQEAGQPIGTWHFGGDEAKNIRLGAGYTDVKKPEAGKGMLDLSKEDKPWAKSQACQRLIDSGKVADMEHLPSYFGQEVSKLVKAHGIDRMQAWQDGLKDAKDAKAFATSRVGVNFWDTLYWGGFDSVNDWANKGYEVVVSNPDYVYLDFPYEVNPNDSGYYWGTRFSDERKIFSFAPDNMPQNAETSVDRDGNAFSAKSDKPWPGAHGLSAQLWSEVVRTDPQMEYMIFPRALSVAERAWHRADWELDYQAGREYKGGETRFVDGKKLAQEWQVFANILGQRELAKLDAGGISYRLPVPGARIVGGRLEANIALPGLTIEYSTDGGQRWQRYDDAARPAVQGEVQVRSASPDGKRFSRAEPVTA

SEQ ID NO: 3791 - protein, 887 aa, Serratia sp.
MNKFKLSALAVLAATAGMFGAAGSAMADQPLVERLSQLKLNIKMLDNRAADSGVDCARLGADWAACNKVLITLANDGQAITAKDWAIYFHSPRQTLEVGNKQFRITHLTGDLYKLEPTAAFRGFPANQAVEIPIVAEYWQLFKTDFLPRWYATAGDAKPQVLVNTDSEDLDRFVAPFGDDQWKRTKDDNNVLMTPASRFTRNADVQTLPAASLRGQIIPTPMSVQIHAQDIDLGNGVALNLDALDQASAEVVRERFKQLGVASAATGYPIVTEIRPASFSGEMAQSGAYKLTLGEKEARITGFDQSGVFYGLQSILSLIPLNGEKKIAALEASDAPRFAYRGLFLDVARNFHHKDAVLRLLDQMAAYKLNKFHFHLTDDEGWRIEIPGLPELTDVGAQRCHDLSETTCLLPQYGQGPDVYGGFFSRQDYIDILKYAQARHIEVIPEIDMPAHARAAVVSMEARYQKLMAQGKQQEAEAYRLVDPTDTSNTTSVQFFNRQSYLNPCLDSSTRFVDKVMGELVKMHQEAGQPIGTWHFGGDEAKNIRLGAGYTDVKKPEAGKGMLDLSKEDKPWAKSQACQRLIDSGKVADMEHLPSYFGQEVSKLVKAHGIDRMQAWQDGLKDAKDAKAFATSRVGVNFWDTLYWGGFDSVNDWANKGYEVVVSNPDYVYLDFPYEVNPNDSGYYWGTRFSDERKIFSFAPDNMPQNAETSVDRDGNAFSAKSDKPWPGAHGLSAQLWSEVVRTDPQMEYMIFPRALSVAERAWHRADWELDYQAGREYKGGETRFVDGKKLAQEWQVFANILGQRELAKLDAGGIRYRLPVPGARIDGGRLEANIALPGLTIEYSTDGGQSWQRYDDAARPAVQGEVQVRSASPDGKRFSRAEPVTA

SEQ ID NO: 3792 - protein, 893 aa, Yersinia sp.
MNKFKLSALAALTATFGLMGAAQASPADQQVVDQLSQLKVNFKIKDNRAADNGTDCAALGADWASCNKTLITLTNAGDEIQGKDWALYFHNVRQVLAVGNDQFKITHLTGDLHKIEPTDKFSGFPANKAVEIPITGEYWQLFETDFMPRWYATSGDVQPKVLASTDTEDIDQFLTRFTGDQWKRTKDDNNVLMTPESRFVKNESLKTLPAESLRGQIIPTPMSVKVHNADVDLSKGVALELSALPKPAADAAQKRFEMLGVNVNAAGYPITTMIQPSDFKGDLAVAGAYELKIGEQGAQVIGFDQTGVFYGLQSILSLIPSDGSKKIATLDAKDAPRFEYRALFLDVGRNFKTKDAVLRLLDQMSAYKLNKFHFHLSDDEGWRIEIPGLPELTEVGSKRCHDLSENACLLPQLGSGPDSNNLGSGHFSRQDYIDILKYAKARQIEVIPEIDMPAHARAAVVSMEARYNNLMKQGKEAEANEFRLLDPTDDSNTTSVQFYERKSYLNPCLDSSKRFVDKVIGEMAQMHKEAGMPLQTWHFGGDEAKNIRLGAGFQDKNGKIEPGKGIIDQSIEDKPWAKSQVCQDMVKQGKIEDVEHLASHFAIEVSKLVNAHGIEKMQAWQDGLKNAKDAKAFATKRVGVNFWDTLYWGGADSVNDWANKGYEVIASNPDYVYFDMPYEVNPRERGYYWATRFTDEAKVFSFAPNNMPQNAETSVDRDGNHFSAKSDKPWPGVHGISGQSWNETVRTDDQMEYMMFPRALPLAERAWHRAPWEQDYKAGREYKGGETHHVDTQALSADWQRFANIMGQRELAKLDKAGISYRLPVPGARVQGGLLEANVSLPGLTIEYSVDGGQQWQKYDIKNQPKVSGEVMIRSASPDGKRNSRAEVVSATL

SEQ ID NO: 3793 - protein, 891 aa, Yersinia sp.
MNKFKLSTLAAITATFGLMGSALADTTPQQLVDQLSTLKVNYKILDNRAGENGVDCAKLGADWASCNKVLITLTNTGDEIKGQDWAIYFHSIRQILAVDNDQFRITHLTGDLHKIEPTAKFAGFPANQAVEIPITGEYWQLFATDFMPRWYATSGDAKPKVLKSTDTEDINEYLTQFTGDQWKRTKDDNNVLMTPESRFVKNEAVKTLTAANLRGQIIPTPMDVKVYPQDVNLSQGVALDLSALPQPAAEVVQQRFELLGLKPNAAGFPIKTSIQPAKFKGDLAVSGAYELKIGEKGAQVIGFDPTGVFYGLQSILSLVPTDGSQKIATLDAKDAPRFDYRGVFLDVGRNFKTKDAVLRLLDQMAAYKLNKFHFHLSDDEGWRIEIPGLPELTEVGSKRCHDLTENTCLLPQLGSGPDSNNLGSGHFTRADYIDILKYAKARQIDVIPEIDMPAHARAAVVSMEARYNNLMKQGKEKEANEFRLLDPTDDSNTTSVQFYERKSYLNPCLDSSKRFVDKVIGEMAQMHKEAGMPLTTWHFGGDEAKNIRLGAGFQDKNGPIEPGKGIIDKSVEDKPWAKSQVCQDMVKQGKIQDVEHLSSHFAIEVSKLVNAHGIERMQAWQDGLKDAKDAKDFATKRVGVNFWDTLFWGGADAINDWANKGYEVVASNPDYVYFDMPYEVNPNERGYYWATRFSDEAKVFSFAPNNMPQNAETSVDRDGNHFSAKSDKPWPGVHGISGQSWNETVRTDEQMEYMIFPRVLPLAERAWHRAPWEQDYQAGREYIGGETHHVDTKALSIDWQRFANIMGQRELAKLDKAGIAYRLPVPGARVVAGQLEANISLPGLNIEYSTDGGQHWQQYDAKVQPKVSGDVLIRSTSSDGKRSSRAEPVKA

SEQ ID NO: 3794 - protein, 896 aa, Yersinia sp.
MNKFKLHALAALTATFGFMSAVHASPADQLVVDQLSQLKVNFKMQDNRAAEKGTDCAALGADWASCNKTLITLTNTGDKIQGKDWALYFHNVRQVLAVGNDQFKITHVTGDLHKIEPTDKFSGFPANKAVEIPITGEYWQLFETDFMPRWYATSGDAKPKVLSSTDTENIDQFLTRFTGDQWKRTKDDNNVLMTPESRFVKNESLKTLPAKSLRGQIVPTPMNVKVHQGDVDLSNGVALELSALPKPAADAVQQRFDMLGVNAKATGFPISTQIKPSAFKGDLAVSGAYELKIGEKGAQVIGFDPAGVFYGLQSILSLVPTDGSKKIAMLDAKDAPRFEYRALFLDVGRNFKTKQAVLRLLDQMSAYKLNKFHFHLSDDEGWRIEIPGLPELTDVGSKRCHDLTETTCLLPQLGSGPDSNNLGSGHFSRSDYIDILKYAKARQIEVIPEIDIPAHARAAVVSMEARYNNLMKEGKEGKEAEAKEFRLLDPTDDSNTTSVQFYDRKSYLNPCLDSSKRFVDKVIGEMAQMHKEAGMPLQTWHFGGDEAKNIRLGAGYQDKNGKIEPGKGIIDQSIEDKPWAKSQVCQDMVKQGKVQDVAHLSSYFAIEVSKLVNAHGIEKMQAWQDGLKDAKGAQDFATKRVGVNFWDTLYWGGADSINDWANKGYEVIASNPDYVYFDMPYEVNPLERGYYWATRFNDEAKVFSFAPNNMPQNAETSVDRDGNHFSAKSDKPWPGVTGISGQSWNETVRTDEQLEYMVFPRALPLAERAWHRASWEQDYQAGREYKGGETQFVDIKALSSDWQRFANIMGQRELAKLDKAGIAYRLPVPGARIQGGLLEANVSLPGLAIEYSVDGGKQWQKYDMKVQPKVSGEVMIRSTSPDGKRASRAEVVSSTF

SEQ ID NO: 3795 - protein, 892 aa, Yersinia sp.
MMNRFKLNALAAMAATLGLMGYANADTAPQQLVDKLSTLKVNYKILDNRAAEHGVDCAKLGADWASCNKVMITLTNTGDQITGQDWAIYFHSIRQILAVDNSQFKITHLTGDLHKIEPTEKFAGFPANQVVEIPITGEYWQLFATDFMPRWYATSGNAKPKVLKNTDTEDINEYLTQFTGDNWQRTKDDNNVLMTPESRFVKNAAVKTLAAADLRGQIIPTPLEVKIHQQDVDLSKGVALDLSALPQSGAEAVQQRFELLGLTLNSAGFPIKTAIQPADFKGDLALSGAYQLKIGEQGAQVIGFDPAGVFYGLQSILSLVPTDGSKNIATLDAQDAPRFEYRGVFLDVGRNFKTKAAVLRLLDQMAAYKLNKFHFHLSDDEGWRIEIPGLPELTEVGGKRCHDLTENTCLLPQLGSGPDSNNLGSGYFTRADYLDILHYAKARQIEVIPEIDMPAHARAAVVSMEARYHNLMKQGKETAANEFRLLDPTDDSNTTSVQFYERKSYLNPCLDSSKRFVDKVIGEMAQMHKEAGMPLTTWHFGGDEAKNIRLGAGFQDKNGTIEPGKGIIDKGVEDKPWAKSQVCQDRVKQGKIQDVEHLASYFGIEVSKLVNAHGIEKMQAWQDGLKDAKSAKDFATKRVGVNFWDTLYWGGADSINDWANKGYEVVASNPDYVYFDMPYEVNPNERGYYWATRFTDEAKVFSFAPNNMPQNAETSVDRDGNHFSAKSDKPWPGVQGISGQSWNETVRTDKQMEYMIFPRVLPLAERAWHRASWEQDYQAGREYQGGKTHHVDTQALNTDWQRFANIMGQRELAKLDKSGVAYRLPVPGARVVGGILEANLSLPGLIIEFSTDGGKQWQQYDAKVPTKVSGEVLIRATSPDGKRSSRAEPVKV

SEQ ID NO: 3796 - protein, 889 aa, Edwardsiella sp.
MMKGYKLSVVATALGMLGMSGMAQADQQLVDRISSQVKVNYAVTDNRGAENGVNCAALGADWASCNQAVISLTNDGSAIEGKDWAIYFHNIRQILKSGNDQFKITFVTGDLHKIEPTDKFKGFAAGERVEIPIVGEYWQLFESDVLPRWYVTSPDAKPKVIANTDTEDLSQFVTPFSGDLWKRTQDDKNILMTPENRFAKNADVKTLPASSLRGQIMPTPMSLKVHQQDADLARGVSLDLTVLNNASADVIKARLSQLGVKQVKGGYPIKTQIATKAFKGDMAVAGAYQLKIGTKGAEVTGYDQAGVFYGLQSILSLLPADGSAKIATLDAEDAPRFQYRGIELDVGRNFHSLASIERLLDQMAAYKLNKFHFHLTDDEGWRIEIPGLPELTEIGGKRCHDLTEQTCLLPQLGSGPDSDNNGSGYFTRADYIKLLKYAQARHIEVIPEIDMPAHARAAVVAMEARYNKLKAAGNEKGANEYRLLDPTDDSNTTSVQFYDRHSYLNPCLDSSKRFVDKVIGEIAQMHREAGQPLTTWHFGGDEAKNIRLGPGYTDVSKPEPGKGMLDLSKEDKPWAKSQACQAMINTGKVADMDHLPSHFAVEVSKMVKDHGIGKMQAWQDGLKDAKDAKAFATPRVGVNFWDTLYWGGFDSANDWANKGYEVIISNPDYVYMDFPYEVNPKENGYYWGTRFSDERKIFAFAPDNLPQNAETSVDRDGNYFTAKSDKPWPGAHGLSAQLWSEVVRTDDMMEYKIYPRIMAVAERAWHQAGWEQPYQAGREYKGGETHLVDQQALLKDWQRFANLMGQRELAKMDKSGVAYRVPQPGARVVDGKLETNVAMPGLVVEYSVDGGKQWQRYDAQAQPTVSGEVQVRTVSPDGQRFSRVESVKP

SEQ ID NO: 3797 - protein, 889 aa, unknown
  environmental sample
MILSRRTKLAAAVALGLLGSASLSQADQKTVDELSRLKAQVTVKDNRAAERGIDCAALGADWASCNLWSVTLTSDADIFSKDWAIYFHNPRQVLKVQNEQFKVTFITGDLHRIEPTEKFQGFKAGQAVEIPFIGEYWQLFESDIMPRWYATSTDARPKVIASTDTEDLRQFVTPFTGELWKRTPDDHNILMLPGSRFESNADLALLPATSLRGQIVPTPQKVKISDHDADLSHGVTLDLAALDPASAAAVQQRFALLGVKSVAKGYPISATVAASAFKGKQAVSGAYQLFIGEKGAQVRGYDQAGVFHGLQSILSLLPADGGAKIAVLEAQDAPRFPYRGIQLDVGRNFHSKAAVERLLDQMAAYKMNRFHFHLTDDEGWRLEIPGLPELTEIGSRRCHDLEEKTCLLPQLGSGPNSDNNGSGYLTRADYIDIVKYARARQIEVIPEIDMPAHTRAAIISMEARHAKLLAAGDEKGADEFRLLDPTDTSNTTSVQFYDRRSYLNPCLESSKRFVDKIIGEVAKMHDEAGQPLKTWHFGGDEAKNIRLGTGYQDKNGKIEPGKGIIDQSVEDKPWARSQACQALVANGVVADMEHLPSHFAVEVSQLIRQHGIDGMQAWQDGLKDAKDAKAFATRRVAVNFWDTLYWGGYDSVNDWANKGYDVVISNPDYVYLDFPAEVNPQENGYYWGTRYSDERKVFSFAPDNLPQNAETSLDRDGNPFTAKSDKPWPGAHGLSAQLWSETTRTDEMMEYKLYPRLLSVAERAWHRAGWEQDYQAGREYKGGETHWVDTKALRGDWLRFANLLGQRELAKMDKAGVGYRLPVPGAKVVEGKLQANIALPGLTIEYSTDGGQHWQPYDQKAQPQVSGAVQIRSVSPDGQRHSREEPVGI

SEQ ID NO: 3798 - protein, 397 aa, Stenotrophomonas Sp.
MFLRRIPASADHARRGEVWLLSGGPGESGASLYPLIQTYQRAFPGFDLVIPDHRGTGRSSRICPVQESPESPEGRGLAGTEWGPCIGSMYANLQRTSAFSITEAAQDLGILMSDGDRGGQVLLYGVSYGTQLALRALQVNELDVDGLILDGLVPPETTEKFDLSRRTALVDQVGRESMDEGSLVRYRTLLAAKDAAWQREVPGGDVRRFFAALLSFPALRDRIPKIVQDLSAGDARSLVATANDWNIALAQLGQGGNNQPALPLVMLIAASENNARPELSLATVDEEARHALFASPIPGLLVNGGVPRYPRDAWFGKSPRTLPRTLVMQGTLDPNTAYAGAVEHSATLAGSGPVTFHTVDRGAHLLALVAPRCFVAAVESFIEGAVVSERCAEPASG

SEQ ID NO: 3799 - protein, 397 aa, Stenotrophomonas Sp.
MFLRRIAASADVPRRGEVWLISGGPGESGASLYPLIQTYQRAFPGFDLVIPDHRGTGRSSRICPIQEAPESPAGTGLADAEWGPCIGSMYANLQRTSAFSITEAAQDLGILMSQADRSGQVLLYGVSYGTQLALRSLQVNELDVDGLILDGLVPPETTETWDLSRRTALVDQVGRQSMDERSLQQYRTLLAVKDAAWQKDVPGGDLRRFFAALLSFPALRDRMPKIVQDLSEGDARTLVATVKDWNAALAQLGQAGNNQPALPLVMLIAASENNARPELSMETVNEEAKDALFVSPIPGLLVSGSVPRYTRDAWFGKTPDTLPRTLILQGTLDPNTAYAGAQEHAAMLRRSGPVTFHTVDRGAHLLPLVAPGCFVAAVGSFIGGGMVSERCAEPLLE

SEQ ID NO: 3800 - protein, 397 aa, Stenotrophomonas Sp.
MFLRRIPASAEVPRQGEVWLLSGGPGESGASLYPLIQTYQRAFPGFDLVIPDHRGTGRSSRICPIQEAPESPEGTGLAGSEWGPCISSMYANLQRTSAFSVTEAAHDLGVLMSGAERGGQVLLYGVSYGTQLALRSLQVNDLHVDALILDGLVPPETTETWDLSRRTALVDKVGRQSMDERSLQQYRLLLAAKDAAWQKVVPGGDLRRFFAALLSFPTLRDRMPKIVQDLSEGDTRTLAATVKDWNAALAQLGQGGNNQPALPLVMLIATSENNARPELSLETVNEEAKNALFVSPIPGLLVSGSVPRYPRDAWFGKTPDTLPRTLILQGTLDPNTAYTGAQEHAALLRRSGPATFHTVDRGAHLLPLVAPRCFVSAVGSFINGDVVSERCAEPVPE

SEQ ID NO: 3801 - protein, 849 aa, Streptomyces sp.
MRTTALPLALSLAAGGLITTTATTAHATTAHAATYGTVREAFNNTAISPDGEPAAADFDAAGRSLSATDLDKAGWRRGTRVTIGATTYTRADVAPGQPDNVMAAGQILTTRGAGNALGFLASATSGPVAAPVTVTYTDGTSAQQTLEVPDWTAGATTTAALSLDHRNTPSGQQTAPARLHAVTVPLDPHKTVASVTLPKTGSSAAPGAPALHVFDLAVRSTPAAPGGKFWAGSWGASFGSAQPVAQPGWAQQTLRMVVNPHTSGGTARIRFANTFSPQPIRLGHVTVAAQAAAGGAAATQVPVSLTFGGAAETTLPAGGEIYSDPVAFPVTAGKNLLVSIYLPDQVTTAPTHDYALTTSFISNRQAGDHTADTAATAFPGTLSHWTLVNGIDVAAAENIGTVVTLGDSQTDGAHSTPDRNQRWPDHYAAALNAASRPTGVVNAGISANRLLTDRADTAGPSALSRLDRDVFAQSNVRTVVVYEGINDLAHDNASAQSVTDAIRRICARAKARDIRVIVATLPAFGGYSAYSDAKETARQQVNAAIRTMTEADAPTDFDLATRDPDMPSQLLPSMLKPGGDHLHFGDAGTKVLADTLVRAADAPSLAMSQTTAADFNGDGIQDLVARQDSTGTLKMWLGRGNGTFASSTDVTAGWRPYSQTTAADFTSDGKADLIARESSGTLKLWKGHGDGTFGSAITVTGGWEFTQTTAADFDGDGKADLIARDSSANLKIWAGRGDGTFGAGAALSSGWDFTQTTAADFNGDHQADIIARDASGNLKMWTHNAAGYFNAPFTVTGGWSPFSQTTAADFTGDGKADLIARDDNTGDLRSWAGHNDATFASPTTLTGGW

SEQ ID NO: 3802 - protein, 648 aa, Streptomyces sp.
MPFPRRAFRRMRTTALPLVLSLAAGGLIMTTATTARAATYGTVREAFNNTAISPDGEPAAADFDAAGRSLSATDLDKAGWRRGTQVTIGATTYTRADVAPGQPDNVLATGQTLAIRGAGNALGFLASATSGPVTAPVTVSYTDGTSAQQTLEVPDWSAGATTTAALSLDHRNTPSGQQTSPARLHAVTVPLDPRKTVASVTLPKTGSSAAPGAPALHVFDLSVRSTPSAPGGKFWAGSWGASFGSAQPVAQPGWAQQTLRMVVNPHTSGGTARIRFANTFSPHPIRLGHATVAAQAAAGGAAAAQAPLSLTFGGAAETTLPAGGEIYSDPVAFPVTAGRNLLVSIYLPDQVTTVPTHDYALTTSFISNRQAGDHTADTAATAFPGTLSHWTLVNGIDVATTENIGTVVTLGDSQTDGAHSTPDRNQRWPDHYAAALNDTSRPAGVVNAGISANRLLTDRADTAGPSALSRLDRDVFAQSNVRTVVVYEGINDLLHDNASAQAVTDAIRRICARAKARGIRVVVATLPAFGGYSAYSDAKETARQQVNAAIRTMTEADAPTDFDLATRDPDMPSQLLPSMLKPGGGDHLHFGDAGTKVLADTLVRAADGPSVTMSQTAAADFNGDGAQDLVARQDSTGILKMWLGRGNG

SEQ ID NO: 3803 - protein, 360 aa, Streptomyces sp.
MKHRRIPSHRIAIAGAGVAALVAGAFTLNSANATTADPAPAPATLSVASADKLAGTLLSDLGDEAAGSYYDAKERKLVVNVVDEGAAEGVRERGAVARVVEHSLAELKSARATLKAEATIPGTSWSVDPVTNKVVVTADSTVKGAKLEKLNKVVDGLDGRAAVERVAGEFKPFAAGGDAIHSGGGRCSLGFNVVKGGEPYFITAGHCGEQGSSWSDSAGGAAIGTMEESSFPGNDYALVKYASGADHPSAVNLYNGSTQEITRAGDATVGQQVQRSGSTTQVHDGEVTGLNETVNYQEGSVSGLIKTTVCAEPGDSGGSLFAGSTALGLTSGGSGDCSSGGTTFFQPVPEALSAFGASIG

SEQ ID NO: 3804 - protein, 358 aa, Streptomyces sp.
MKHRRIPSHRIAIAGAGVTALVAGAFTLNSANATTAEPAPTTLSAASADKLAGTLLSDLGDEAAGSYYDAKERKLVVNVVDEGAAEDVRERGAVARVVKHTLAELKSARATLKAEATIPGTSWSVDPKTNKVVVTADSTVKGAKLEKLNKVVDGLDGRAAVERVAGEFKPFAAGGDAIHSGGGRCSLGFNVVKGGEPYFITAGHCGSAGSTWSASSGGSAIGTMEESSFPGNDYALVKYASGVDHPSVVNLYNGSTQQITQAGNATVGQQVQRSGSTTQVHGGEVTGLNETVNYQEGSVSGLIKTTVCAEPGDSGGSLFAGSTALGLTSGGSGNCSSGGTTFFQPVPEALSAFGASIG

SEQ ID NO: 3805 - protein, 358 aa, Streptomyces sp.
MKHRRIPKRRVVIAGAGIAALVATGITLQSANAAPGEPQPDTLSVGAAGKLANTLTSSLKSDTAGSYYDAKAKKLVVNVVNKGVVDKVREAGAEAKVVTNTLAELSKARETLKQKATIPGTSWSVDPRSNKVVVTADSSVKGTRMATLNKVADALGDKVEVKRSAGKFSTFIAGGDAIWGDGGRCSLGFNVVKGGQPYFLTAGHCTEAISSWSDSQGGGEIGTNEGSEFPGNDYGLVKYTKDTDHPSAVDLYNGSSQEITKAGDATVGQKVQRSGSTTQVHDGEVTGLNATVNYQEGSVEGLIQTNVCAEPGDSGGALFAGDTALGLTSGGSGDCSSGGETFFQPVPEALQAFGAEIG

SEQ ID NO: 3806 - protein, 361 aa, Streptomyces sp.
MKHRRISRKRATVAGSAVAALVVAGFTFQSANASDEVPQFTVKTLNADAAGKLATTLDRDLGADAAGSYYDTKAKALVVNVVDEAAAEQVRQAGGKARVVEHSLAELKSARQTLTDKATIPGTSWAVDPVSNKVLVTADSTVDGAAWKKLSAVVEGLGGRAELNKSAGEFKPLIAGGDAIFGSGSRCSLGFNVVKDGEPYFLTAGHCTEGVTSWSDTQGGAEIGANEGSSFPENDYGLVKYTSDTEHPSEVNLYNGSTQAITQAGDATVGQQVTRSGSTTQVHDGEVTALDATVNYGNGDIVNGLIQTTVCAEPGDSGGALFAGDTALGLTSGGSGDCSSGGTTFFQPVPEALAAYGAEIG

SEQ ID NO: 3807 - protein, 361 aa, Streptomyces sp.
MKHRRISRKRATLAGSAVVALVAAGFTFQSANASDDVPQFAAKTLSADAAGKLADSLDRDLGADAAGSYYDTTAKALVVNVVDEAGAEQVRQAGAKARIVQNSLAELKSARQTLTDKATIPGTSWAVDPVTNKVKVTADSTVDGAAWKKLSAVVDGLGGKAELTKTKGEFKPLIAGGDAIWGSGSRCSLGFNVVKDGEPYFLTAGHCTESVSSWSDSQGGAEIGANEGSSFPENDYGLVKYTSDTEHPSEVNLYDGSTQAITQAGDATVGQAVTRSGSTTQVHDGEVTGLDATVNYGNGDIVNGLIETTVCAEPGDSGGALFAGDTALGLTSGGSGDCSSGGTTFFQPVPEALAAYGAEIG

SEQ ID NO: 3808 - protein, 361 aa, Streptomyces sp.
MKHRRISRKRTMVAGSAVAALVAAGLTFQTANASDDVPRSEARTLSADAAGKLAATLDEELGADAAGTYYDTGAKALVVNVVDEAAAEQVRQAGGEARIVENSLAELKSARQTLTDRATIPGTSWAVDPVTNKVRVTADSTVDGAAWKKLSAVVDGLGGKAELARSKGEFKPLIAGGDAIWGSGSRCSLGFNVVKDGEPYFLTAGHCTESVTSWSDTQGGSEIGANEGSSFPENDYGLVKYTSDTAHPSEVNLYNGSTQAISRAGDATVGQAVTRSGSTTQVHDGEVTGLDATVNYGNGDIVNGLIETTVCAEPGDSGGALFAGDTALGLTSGGSGDCSSGGTTFFQPVPEALAAYGAEIG

SEQ ID NO: 3809 - protein, 437 aa, Streptomyces sp.
MPRTWRRQMFPTSKKLRTTVAGLALTAASMGLVTATGAQPAVAAEVCTGTASVYGILGDGRLTYSAINTKGDRLKTLIGPDLGFTPKAMATLNFNTILVTSTAGALYRVDVLTNNNALELSGVEKIADSGWTHDKLAYDGYGHLYGTTAAGNLLQYLVSQDKPQGSQHIGQRKEIGTGFVLKTLTATGKDRLLATAADGRLLSYKIIGSAWKRDDLKNDGWSAFDELTSSGGGFYFGRIPTTGAMYWYKDGNISDGSGSDIVYHTNDPVDTSGWTQKLLSAAPDTTSCKQVNTLGQDIAADANREVGNNFNDFDFNHARAWCAEFVEYIWAGNSVDHSRELDARAISLKEYGQRHGTYRTSGPKVGDAVLYDVDRNLNDGEADHVNIVVAVSADGTQIQTVGGNESGKVSKAGWFNWDTASSPVGAGPVLAFVSPKG

SEQ ID NO: 3810 - protein, 431 aa, Streptomyces sp.
MFRTSRTLRTAVTAVAAGAFSLGLVTANTGTAAAAETVCSGTASVYGILPDGRLTYSAINPTNGDRIKTLTGADLGFTPQAMATLNFNTILVTSTTGALYRVDVQTNNTALTLANAPVRIADSGWTHDKLTYDGYGHLYGTTSSGLLLQYTVTEDKPAGSQHIGMRKEIDSGFVLKTLSAVGQDRLIATTVDGKLLSYQIVGDAWRRSDLKTDGWSAFDQLVSPGAGFYYGRIPTTGAMYWYKDGNISDGSGADIAYHTSDPVDASGWTQQLLSAAPRTVSCKSVSTLGQDIANAANAEVGKTFTSYPFTYDYAWCAEFVKYIWAGEDVDYASQLDARAWSLYEYGTNHGTWKTGSPKVGDAVLYDKDGTLGDSEADHVNIVVGVSSDGTQIQTVGGNESHKVSKSGWFTWRTASNPVGAGRVMGFASPIG

SEQ ID NO: 3811 - protein, 325 aa, Streptomyces sp.
MSVQKPASSANATQAAASPDTAQSTTAPAGPDTPAAQDERTAATSEASSAPGTPAEAATTAAGTGGSQARESAESTADEERTAVAAAAVPAVPARTASGVDSGRPRKPILAVAGIVGAALISVPLLLAGGADDDKRPESTKGLAAGEPDTVLAPGSAGAALDDYVVEKPTPTPTEEKPEPSAPVKAVAPPPAPKPEPATSAPAKKAMPKPKAKPTPKPAWTASTVRAVSTLEVNQAWTTNRIRMVMQPDGNLVVYNEKNKPTWASMTFGENHRAIFQSDGNLVIHNGDDRPIWASDTWGNEGAELILREDGKVVIAHSGKVLWST

SEQ ID NO: 3812 - protein, 329 aa, Streptomyces sp.
MSSQKPASGTNTTPASGSSPDTPPSTTAAPPAAEEHTAPAADPAPAPASPAAAAEAGEAAEAGEESTATAAATAEAKEPESAGRRTAVAAAVAAPPPAKTATGVDNGRPRKPVLAVAGILGAVLIAVPLLLAGGAEDEKRPDSAKLAAEDADTVLDPGSAGAALDDYVAEKPSATPKEKPEPSAPVKAVAPPPAPEPATSAPEKKAAPKPEPKPKAKPSPTPDWTTSTVRAVSTLEVNQAWTTNRIRMVMQPDGNLVVYNEKGKATWASMTFGENHRAIFQSDGNLVIHNGEDRPIWASQTWGKEGAELVLRKDGKVVISHNGNVVWST

SEQ ID NO: 3813 - protein, 223 aa, Bacillus sp.
MVTSYMDYTKPDVEYFSDLNTNRLFTRNSENYINRLGRDVLNTLSNVSILDIYLSKGHVVEPHYHQNAAELVYCISGSAVVSFMNPFNNEVKNIPITPGQVANIPQGWWHWEEASENNTHLLAIFDAPYPEYILGSDILTKTPVDVIAHTYCLDPEAWKEAVAPIKNETIIIGPTDECSRKSKNNNQGYTSVHYPNMPLPHPYNPMQYVYSHPHPGYYPGYNC

SEQ ID NO: 3814 - protein, 822 aa, Xanthomonas Sp.
MSDYAASLSMVEKAESLDQISQIARSFSAKSSGQGGILYSRRVGDVSSEVMAVELSGKTGLPIINDTPRAKFLMEARTVIEEKATDIFRAQGLPAKMARESAASFLFGDPQAPSQNPTSLSKCLWREASNEFASSLRGDIKVVASAANLERVFGQVEVPAVLNNPNVTSLGGQPIPKLQALYAQGGAGAVLPEVQTHFIQAAPKGIFVTPESIGTEIKNLTFSREFAESLELKQTHFKPSAELTASGMVRAPTGLDVPAASIAETALSAEAAASRRLASGAVRGLGVVGAAAAVYDLGATARNTARLDAQGNSTAADAEVTRYATRNLGTVGGAVLGTSMGAALGVESGPGLLVTGAIGGVVGAVGGDKLADAINDHRISHQQDAQGNTWRLENHPSGARWAREVSTGEVDPAAIAFGEAGVPLQKTRTEVATPEVSDLLTYKASGTSIELALGSPPQNKDPYTQPANAHDTRSLREAPWVHNPDTQQWTRQVADGLIDRTMSAHTETASPQRAAQLDEASQQIIRQNAMQTPAAMAAHYKQTYEQNGWERHGYMPAAVHDALKHPGRIVGSDGDLYERGNDGQWTHDGMLWDSNAKGNLKQELDATYAAQTLGTQRTAAQSGLPAAAVPITTLDTMHVTAPRMQGQDSADALSKKAQDGIETRGDSAPARPQASGPQDPQHPDHAMLNQIREGVAKIDESVGKPYDAMSERVSRCLLAACKDNRERYPDAGGTSLAANALQRVDHVLMGNNGNLVAIEGRIDDPTHKRAAVSIDQAIHMPLEQSDAKLQAANQAIAQERTQAQQQELARGMHESHQAVPTR

SEQ ID NO: 3815 - protein, 751 aa, Xanthomonas Sp.
MEARTAVEEKASEIFRSQGLPPKMARESAASFLFGDPAVPSQSPTSLSKCLWGEASHEFASSLRGDIKVVASAANLERVFGQVEVPAVLSNPKVTSLGGEPIPKLQTLYAQGGAGAVLPEVQTHFIQAAPKGIFVAPESIGSKIDKVTFSREFAGSLELQQTHFRTSAELTASGMVRAPTGLDVPAASIAETALSAEAAASRKLASGAVRGLGVVGAAAAVYDLGTTARNTARLDAQGNSTAADAEVTRYATRSVGAVGGAVLGGSMGAVLGVESGPGLLVTGAIGGIVGAVGGDKLANAINDHRISHQQDAQGNTWRLENPSSGARWARDVSTGEVDPAAVAFGEAGVPFQRTRTEVALPEVSDLLTFKASNTSIELALGSPPQNKDPYTLPANAHDTRSMRDAPWVHHPDTHQWTRQVADGLVDRTMSTHTETASPQRAAQLDEASQQIIKQNAMQTPAAMAAHYKEAYDQNGWERHGYMPAAVHDALKHPGRIVGSDGDLYERGKDGQWTHDGMLWDSDAKGNLKQELDGTYAAQTLGTQRTAAQPAAQAAAEPIKTLETVHVTAPRAQSHDNADTSSKKTQEDTGVRDLSGTARPQASGPQDTDHPDHAMLKQIREGVAKIDESVGKPYDEMSERVSRCLLAACKDNRERYPEAGNTSLAANALQRVDHVLMGKNGNLVAIEGQMNDPTHKRAAVSIDQAINMPLEQSDAKLQAANQAIAQEQTQTRQQELVRSQQQDAQQAPRMSV

SEQ ID NO: 3816 - protein, 829 aa, Bacillus sp.
MAFIQRYSTTTNGAVTFTGNTLGLSNTNISYTDIGAFITLDLSKQVPGYLAGTTLDWKENASAAQLRLPTGSIVLYAELIWGGSTKTSTEDVTSEIDRAITLISPKGSTLITPDPTTSQQVAQANQIFYVRSANVTSFIDAGGAGNYTVSGVPATVQRYKGNNVGGWTLSVVYKDPTLPLRNMNIHVGTASIEKTGSVSQKISGFSTPELGDVKARLLLTAMEGDSKIPGDQLLFGKDASSLKPISGPNNPIDNFFASQINDDAGNLDTSGTYGNVNVIPGSAGPAVRYNWDITNVDASTAMENSQTEALVQLTSKSDGYIVTGLGVQIDVNSPEIKINKEVDKEAAIVGEILTYTLLIENSGMTEAQKTILKDTLPPELKFVEDSLQIDGVPIPGGDPTKGVDIGSISIEGPTEVTFQTLVLKVPPDNRAVNKATVVYDFQSAPGLPVSSGTADSNEAITVIRKVEVEVVKRQDMSVYVKAGNIITYTIEVANTGDTQLTDVVIEDQIPNGTKLVPGSLQIDGSPLSGNIESGVNIGTVEPGTTTRVTFQVLIDNPVPKKVTNKAKVDYKYKLIPDGQIYRKVEMTNEVTAIHESNCKEAQKKIVTGIGEAELAAAGVIVAEKLKIQDAIRAFNEGKQSAEELLNENEQLTHKLTKIILDEKLQQDTLQKAKILCCDGIDGIEGIDYSGVYSIKNKGSQKVLDISSASKDNGVNVQQWDYNGGDHQKWELEKMADGYYKIKAVHSGKLLTVSGASNSDGANVEQWEDIGGDNQKWKIEKNSDGTLKLIAKHSGQLLDLKSSIQNNGANIQQWPDNGTDAQCWELTKSK

SEQ ID NO: 3817 - protein, 826 aa, Bacillus sp.
MAFIQRYSTTTNGAVTFTGNTLGLSNTNISYTDIGAFITLDLSKQVPGYPAGTTLDWKENASAAQLRLPTGSIVLYAELIWGGSTKTSTEDVTSEIDRAITLISPKGSTLITPDPTTSQQVAQANQIFYVRSANVTSFIDAGGAGNYTVSGVPATVQRYKGNNVGGWTLSVVYKDPTLPLRNMNIHVGTASIEKTGSVSQKISGFSTPELGDVKARLLLTAMEGDSKIPGDQLLFGKDASSLKPISGPNNPIDNFFASQINDDAGNLDTSGTYGNVNVTPGSAGPAVRYNWDITNVDASTAMENSQTEALVQLTSKSDGYIVTGLGVQIDVNSPEIKINKEVDKEAAIVGEILTYTLLIENSGMTEAQKTILKDTLPPELKFVEGSLQVDGVPIPGGDPTKGVDIGSISIEGPTEVTFQALVLKVPPDNRAVNKATVVYDFQSAPGLPVSSGTADSNEAITVIRKVEVEVVKRQDMSVYVKAGNIITYTIEVANTGDTQLTDVVIEDQIPNGTKLVPGSIQIDGRPLSGNIESGVNIGTVEPGMTTRVTFQVLIDNPVPKKVTNKAKVDYKYKLIPDGQIYRKVEMTNEVTAIHESNCKEAQKKIVTGIGEAELAAAGVIVAEKLKIQDAIRAFNEGKQSAEELLNENEQLTHKLTKIILDEKLQQDTLQKAKILCCDGIEGIDYSGVYIIKNKGSQKVLDISSASKDNGVNVQQWDYNGGDNQKWELEKMADGYYKIKAVHSGKLLTVSGASNSDGANVEQWEDIGGDNQKWKIEKNSDGTLKLIAKHSGQLLDLKSSIQNNGANIQQWPDNGTDAQCWELTKLK

SEQ ID NO: 3818 - protein, 829 aa, Bacillus sp.
MAFIQRYSTTTNGAVTFTGNTLGLSNTNISYTDIGAFITLDLSKQVPGYPAGTTLDWKENASAAQLRLPTGSIVLYAELIWGGSTKTSTEDVTSEIDRTITLISPKGSTLITPDPTTSQQVAQANQIFYVRSANVTSFIDAGGAGNYTVSGVPATVQRYKGNNVGGWTLSVVYKDPTLPLRNMNIHVGTASIEKTGSVSQKISGFSTPELGDVKARLLLTAMEGDSKIPGDQLLFGKDASSLKPISGPNNPIDNFFASQINDDAGNLDTSGTYGNVNVIPGSAGPAVRYNWDITNVDASTAMENSQTEALVQLTSKSDGYIVTGLGVQIDVNSPEIKINKEVDKEAAIVGEILTYTLLIENSGMTEAQKTILKDTLPPELKFVEGSLQIDGVPIPGGDPTKGVDIGSISIEGPTEVTFQALVLKVPPDNRAVNKATVVYDFQSAPGLPVSSGTADSNEAITVIRKVEVEVVKRQDMSVYVKAGNIVTYTIEVANTGDTQLTDVVIEDQIPNGTKLVPGSIQIDGRPLSGNIESGVNIGTVEPGTTTRVTFQVLIDNPVPKKVTNKAKVDYKYKLIPDGQIYRKVEMTNEVTAIHESNCKEAQKKIVTGIGEAELAAAGVIVAEKLKIQDAIRAFNEGKQSAEELLNENEQLTHKLTKIILDEKLQQDTLQKAKILCCDGIDGIEGIDYSGVYIIKNKGSQKVLDISSASKDNGVNVQQWDYNGGDHQKWELEKMADGYYKIKAVHSGKLLTVSGASNSDGANVEQWEDIGGDNQKWKIEKNSDGTLKLIAKHSGQLLDLKSSIQNNGANIQQWPDNGTDAQCWELTKLK

SEQ ID NO: 3819 - protein, 826 aa, Bacillus sp.
MAFIQRYSTTTNGAVTFTGNTLGLSNTNISYTDIGAFITLDLSKQVPGYPAGTTLDWKENASAAQLRLPTGSIVLYAELIWGGSTKTSTEDVTSEIDRAITLISPKGSTLITPDPTTSQQVAQANQIFYVRSADVTSFIDAGGAGNYTVSGVPATVQRYKGNNVGGWTLSVVYKDPTLPLRNMNIHVGTASIEKTGSVSQKISGFSTPELGDVKARLLLTAMEGDSKIPGDQLLFGKDASSLKPISGPNNPIDNFFASQINDDAGNLDTSGTYGNVNVIPGSAGPAVRYNWDITNVDASTAMENSQTEALVQLTSKSDGYIVTGLGVQIDVNSPEIKINKEVNKEAAIVGEILTYTLLIENSGMTEAQKTILKDTLPPELKFVEGSLQVDGVPIPGGDPTKGVDIGSISIEGPTEVTFQALVLKVPPDNRAVNKATVVYDFQSAPGLPVSAGTADSNEAITVIRKVEVEVVKRQDMSVYVKAGNIITYTIEVANTGDTPLTDVVIEDQVPNGTKLVPGSLQIDGRPLSGNIESGVNIGTVEPGTTTRVTFQVLIDNPVPKKVANKAKVDYKYRLIPDGQIYRKEEMTNEVTAIHESNCKEAQKKIVTGIGEAELAAAGVIVAEKLKIQDAIRAFNEGKQSAEELLNENEQLTHKLTKIILDEKLQQDTLQKAKILCCDGIEGIDYSGVYIIKNKGSQKVLDISSASMDNGVNVQQWDYNGGDHQKWELEKMADGYYKIKAVHSGKLLTVSGASNSDGANVEQWEDIGGDNQKWKIEKNSDGTLKLIAKHSGQLLDLKSSIQNNGANIQQWPDNGTDAQCWELTKLK

SEQ ID NO: 3820 - protein, 826 aa, Bacillus sp.
MAFIQRYSTTTNGAITFTGNTLGLSNTNISYTDIGAFITLDLSRQVPGYPAGTTLDWKENASAAQLRLPTGSIVLYAELIWGGSTKTSTEDVTSEIDRDITLISPKGSTLITPDSTTSQQVAQANQIFYVRSANVTSLIDAGGAGNYTVSGVPATVQRYKGNNVGGWTLSVVYKDPTLPLRNMNIYVGTASIEKTGSVSQKISGFSTPDLGDVKARVLLNAMEGDSKIPGDQLLFGKDASSLKPISGPNNPIDNFFASQINDDAGNLDTSGTYGNVNVTPGSAGPAVRYNWDITNVDASAAMENSQTEALVQLTSKSDGYIVTGLGVQIDVNSPEIKINKEVDKEAAIVGEILTYTLLIENSGMTEAQKTILKDTLPPELKFVEGSLQVDGVPIPGGDPTKGVDIGSISIEGPTEVTFQALVLKVPPDNRAVNKATVVYDFQSAPGLPVSSGTADSNEVITVIRKVEVEVVKRQDMSVYVKAGNVITYTIEVANTGDTPLTDVVIEDQVPNGTKLVPGSLQIDGRPLSGNIESGVNIGTVEPGTTTRVTFQVLIDNPVPKKVTNKAKVDYKYKLIPDGQIYRKEEMTNEVTAIHESNCKEAQKKIVTGIGEAELAAAGVIVAEKLKIQDAIRAFNEGKQSAEELLNVNEQLTHKLTKIILDEKLQQDTLQKAKILCCDGIDGLDYSGVYIIKNKGSQKVLDISSASKDNGVNVQQWEYNGGDQQKWELEKLADGYYKIKAVHSGKLLTVSGASNSDGANVEQWEDIGGDNQKWKIEKSSDGTLKLIAKHSGQLLDLKSSLQNNGANIQQWPDNGTDAQCWELTKLK

SEQ ID NO: 3821 - protein, 785 aa, Bacillus sp.
MSKQVPGYPAGTTLDWKENASAAQLRLPTGSIVLYAELIWGGSTKTSTEDVTSEIDRAITLISPKGSTLITPDPTTSQQVAQANQIFYVRSANVTSFIDAGGAGNYTVSGVPATVQRYKGNNVGGWTLSVVYKDPTLPLRNMNIHVGTASIEKTGSVSQKISGFSTPELGDVKARLLLTAMEGDSKIPGDQLLFGKDASSLKPISGPNNPIDNFFASQINDDAGNLDTSGTYGNVNVIPGSAGPAVRYNWDITNVDASTAMENSQTEALVQLTSKSDGYIVTGLGVQIDVNSPEIKINKEVDKEAAIVGEILTYTLLIENSGMTEAQKTILKDTLPPELKFVEDSLQIDGVPIPGGDPTKGVDIGSISIEGPTEVTFQTLVLKVPPDNRAVNKATVVYDFQSAPGLPVSSGTADSNEAITVIRKVEVEVVKRQDMSVYVKAGNIITYTIEVANTGDTQLTDVVIEDQIPNGTKLVPGSLQIDGRPLSGNIESGVNIGTVEPGTTTRVTFQVLIDNPVPKKVTNKAKVDYKYKLIPDGQIYRKVEMTNEVTAIHESNCKEAQKKIVTGIGEAELAAAGVIVAEKLKIQDAIRAFNEGKQSAEELLNENEQLTHKLTKTILDEKLQQDTLQKAKILCCDGIEGIDYSGVYIIKNKGSQKVLDISSASKDNGVNVQQWDYNGGDHQKWELEKMADGYYKIKAVHSGKLLTVSGASNSDGANVEQWEDIGGDHQKWKIEKNSDGTLKLIAKHSGQLLDLKSSIQNNGANIQQWPDNGTDAQCWELTKLK

SEQ ID NO: 3822 - protein, 826 aa, Bacillus sp.
MAFIQRYSTTTNGAITFTGNTLGLSNTNISYTDIGAFITLDLSKQVPGYPAGTTLDWKENASAAQLRLPTGSIVLYAELIWGGSTKTSTEDVTSEIDRAITLISPKGSTLITPDPTTSQQVAQANQIFYVRSANVTNLIDAGGTGKYTVSGVPATVQRYKGNNVAGWTLSVVYKDPTLPLRNMNVHVGTASIEKTGSISQKIAGFSTPQLGDVKARLLLTAMEGDSKIPGDQLLFGKDVSSLNPISGPNNPIDNFFASQINDDAGNLDTSGTYGNVNVTPGSAEPAVRYNWDITNVDASTAMENSQTEALVQLTSKSDGYIVTGLGVQIDVNSPEIKINKEVDKEAAIVGEILTYTLLIENSGMTEAQKTILKDTLPPELKFVENSLQVDGVPIPGGDPTKGVDIGSISIEGPTEVTFQALVLKVPPDNQAVNKATVVYDFQSAPGLPVSAGTANSNEAITVIRKVEVEVVKQQDMSVYVKAGNIITYTIEVANTGDTPLTDVVIEDQVPNGTKLVPGSLQIDGRPLSGNIESGVNIGTVGPGTTTRVTFQVLIGDPVPKKVTNKAKVNYKYKLIPDGQIYRKEEMTNEVTAIHESNCEEAQKKIVTGIGEAELVAAGVIVAEKLKIQDAIRAFNEGKQTAEELLNVNKQLTHKLTKIILDEKLQQDTLQKAKILCCDGIVGLDYSGVYIIKNRGSQKVLDISSASKDNSANVQQWDYNGGDHQKWELEKLADGYYKIKAVHSGKLLTVSGVSNSDGANVEQWEDIGGDNQKWKIEKNSDGTFKLIAKHSGQLLDLKSSMQNNGANIQQWPDNGTDAQRWELTKLK

SEQ ID NO: 3823 - protein, 784 aa, Bacillus sp.
MSKQVPGYPAGTTLDWKENASAAQLRLPTGSIVLYAELIWGGSTKTSTEDVTSEIDRAITLISPKGSTLITPDPTTSQQVAQANQIFYVRSANVTSFIDAGGAGNYTVSGVPATVQRYKGNNVGGWTLSVVYKDPTLPLRNMNIHVGTASIEKTGSVSQKISGFSTPELGDVKARLLLTAMEGDSKIPGDQLLFGKDASSLKPISGPNNPIDNFFASQINDDAGNLDTSGTYGNVNVIPGSAGPAVRYNWDITNVDASTAMENSQTEALVQLTSKSDGYIVTGLGVQIDVNSPEIKINKEVNKEAAIVGEILTYTLLIENSGMTEAQKTILKDTLPPELKFVEGSLQIDGVPIPGGDPIKGVDIGSISIEGPTEVTFQALVLKVPPDNRAVNKATVVYDFQSAPGLPVSSGTADSNEAITVIRKVEVEVVKRQDMSVYVKAGNIITYTIEFANTGDTQLTDVVIEDQVPNGTKLVPGSLQIDGRPISGNIEGGVNIGTVEPGTTTRVTFQVLIDNPVPKKVTNKAKVDYKYKLIPDGQIYRKVEMTNEVTAIHESNCKEAQKKIVTGIGEAELAAAGVIVAEKLKIQDAIRAFNEGKQSAEELLNENEQLTHKLTKIILDEKLQQDTLQKAKILCCDGIEGIDYSGVYIIKNKGSQKVLDISSASMDNGVNVQQWDYNGGDHQKWELEKLDGYYKIKAVHSGKLLTVSGASNSDGANVEQWEDIGGDNQKWKIEKNSDGTLKLIAKHSGQLLDLKSSIQNNGANIQQWPDNGTDAQCWELTKLK

SEQ ID NO: 3824 - protein, 788 aa, Bacillus sp.
MSKQVPGYLAGTTLDWKENASAAQLRLPTGSIVLYAELIWGGSTKTSTEDVTSEIDRAITLISPKGSTLITPDPTTSQQVAQANQIFYVRSANVTSFIDAGGAGNYTVSGVPATVQRYKGNNVGGWTLSVVYKDPTLPLRNMNIHVGTASIEKTGSVSQKISGFSTPELGDVKARLLLTAMEGDSKIPGDQLLFGKDASSLKPISGPNNPIDNFFASQINDDAGNLDTSGTYGNVNVTPGNAGPAVRYNWDITNVDASTAMENSQTEALVQLTSKSDGYIVTGLGVQIDVNSPEIKINKEVDKEAAIVGEILTYTLLIENSGMTEAQKTILKDTLPPELKFVEGSLQVDGVPIPGGDPTKGVDIGSISIEGPTEVTFQALVLKVPSDNRAVNKATVVYDFQSAPGLPVSVGTADSNEAITVIRKVEIEVVKRQDMSVYVKAGNIITYTIEVANTGDTQLTDVVIEDQIPNGTKLVPGSLQIDGSPLSGNIESGVNIGTVEPGTTTRVTFQVLIDNPVPKKVTNKAKVDYKYKLIPDGQIYRKVEMTNEVTAIHESNCKEAQKKIVTGIGEAELAAAGVIVAEKLKIQDAIRAFNEGKQSAEELLNENEQLTHKLTKIILDEKLQQDTLQKAKILCCDGIDGIEGIDYSGVYSIKNKGSQKVLDISSASKDNGVNVQQWDYNGGDHQKWELEKMADGYYKIKAVHSGKLLTVSGASNSDGANVEQWEDIGGDNQKWKIEKNSDGTLKLIAKHSGQLLDLKSSIQNNGANIQQWPDNGTDAQCWELTKSK

SEQ ID NO: 3825 - protein, 825 aa, Bacillus sp.
MAFIQRYSTTTNGAITFTGNTLGLSNTNTSYTDIGAFITLDLSKQVPGYPAGTTLDWKENASAAQLRLPTGSQVLYAELIWGGSTKTSIEDVTNEIDRTITLTSPKGTTLITPDPTTSQQVAQANQIFYVRSANVTSFIDAGGAGKYTVSGVPATAQRYKGNNVGGWTLSVVYKDPTLPLRNMNIHVGTASIEKTGSRSQKISGFSTPELGDVKARLLLTAMEGDSKIPGDQLLFGKDVSSLKPISGPNNPIDNFFASQINDDAGNLDTSGTYGNVNVTPGSAGAAVRYNWDITNVDASSAMENSQTEALVQLTSKSDGYIVTGLGVQIDVNSPEIKVNKEVDKEAAIVGEILTYTLLIENNGMTEAQKTILKDTLPPELKFVEGSLQVDGVPIPGGDPTKGIDIGSISIEGPTEVTFQALVLKVPTDNRAVNKATVVYDFQSAPGLPVSAGTADSNEAITVIRKVEVEVAKRQDMPVYFKAGNVITYTIEVVNTGDTPLTDVVIEDQIPNGTKLVSGSLQIDGRPLSGNIESGVNIGTVEPGTTARVTFQVLIGNPVPTKVTNKAKVDYKYKLIPDGQMYRKEEMTNEVTAIHESNCKEAQKKIVTGIGEAELAAAGVIVAEKLKIQDAIRAFNEGKLSAEELLNVNEQLTQKLRKITSDEKQQQDTLQKAKKLCCEGVDDIDYSGVYIIRNKGSQKVLDVFSASKDNGVNVQQWEYNGGDHQKWKLEKQADGYYTIKAVHSGKLLTVSGASNSDGANVEQWEDIGGDNQKWKIVKNSDGTFKWIAKHSGQLLDLKSSMQNNGANIQQWPDNGTDAQRWELTKV

SEQ ID NO: 3826 - protein, 1569 aa, Variovorax sp.
MKIRYFLMAFLAPLVTLLTHAAITGVSPMTTLSNIATAAAEAVADPLPLQGPGLGNLTYTSAELFKPVSMITSLAHPLDPAHSSAYESREVPATYPGRKDYGMNAGIMINGYFLTSFAPDSGLGPGGFLLYDVSNPRQIQLVKKIYEPEARTKEFRETHSFGTAKIGGKTYVVLPSIYGVEFWDFTDINDIKQVKKLALPGVNAGDYEDVSWQLWWQAPYLYVASAGRGIFIVDARDPVNAVVANRGAGKPNPVPTGELGNFRIGPIFTMGNHMVLTAMESNGGFASLDISDPLNPKVLDSIVGTTPFYYATCFDGRNLHASTRGSGARMYSYDLSDRSRFVAEDNRLVIDEQLYCATQDNYVIQGAQTRIHKVDVSNPLNHVEVGRGSILREDDPNFSHSDNGQVAMFGNLVFVGNDHGSGSGFVVHAVDPDTTKPEVKQVSPANGAKQQALTSRIGLGMTDSIRPESVNANTFIVRAVGGNTLAGTYSVQLGIINFHPEQPLSPGTSYEVFLPANGVKDYAGNAIGADYKSTFNTGNATDINLMHYWTLAGNLSDLIGNNNGTPVSGDAFESIGMSFANRTAGVPLKNDSVATVLGGTASLSFYMKTTQAGGPNSWTAPGIFGRDQSGGADDVFWGWLDGNGRIKLSVGNDAGTTSTAVVNDGNWHHVVLTRDAASGAQAVYVDGVKTTSTGLTGNKGLSNKFQVLGQIQGNAALFKGTLAEVRVYGRVLNDSEVGTLRGQAIIGDPGIGGGPKIVNGQLVFDPATLGSSGAQFRWNFGDGTQTAYSTQPRYTYTYTRPGHYTVTLTVRDASGRETFYTYNLTVIVPVTARAPTHTTNIAGDANSVYSVNPDSGTVAAIDAQTLAKRWEVRVGDEPKTLAVGPDGRIWVTVQGEDKLVALSAADGSLSATVPLAYGSGPYGVAFTPDGAKGLLTLESKSVLMSFDPSNGATTGAVALEGNLRGIAVSSDAQVAYVTRFKSKMTGGQLHKVNLQSMSAMPTIALPVDTTTVDTESRARGVANYLSQVVISPDGRRAVLPSKKDNIVRGRFRDGVDLTHDQSVRSILSQVDLQAAAEVFDEQIDFDDRAPARAALFSPPGDYLFVAQMEGNRVAIVDPYSRAVRGEINASSAPHGLYLDAVRKRLFVNNFLARSVSVHDVASVLSSESAAAIFLQNVSTVAQEPMAAAALRGKQVFYNASDRRMSKDNYISCASCHADAGDDGMVWDFTQRGEGLRRTISLMGRRGAGHGKMHWTANFDEVQDFENDVRNEFGGTGFLTNADFAATADPLGAPKAGKSAQLDDLAAYLSSLNKYMRSPARAADGSLSVEAVRGQTVFNTAQCATCHTGGTFRDGLRHDVGTIQLSSGKGINQPLAGLGFDTPTLSGTWNTTAFFHNGQAATLQDVLNSGHGNASSLPAPDVVALREYVRSLDTAPAVVTRIRSDLNPTMCVNIKGGATASGTVAVQWPCGTASNEKFTVTSITGGYVQLVAEHSGLCLAQDGTATTNAPVVQLACTAGNTAQWSLVGGTLRNRASGSCLDVPNGSTTQDTALITWTCNGGNNQNWTQLP

SEQ ID NO: 3827 - protein, 1577 aa, Variovorax sp.
MKIRYFLMAFLAPLVTLLTHAAITGVSPMTTLGNMATAVSEAVADPLPLQGPGLGNLSYTSAELFKPVSMITSLAHPLDPAHSSAYESREVPATYPGRKDYGMNAGIMVNGYFLTSFAPDSGLGPGGFLLYDVSNPRQIRLVKKIYEPDDATGGRTKEFRETHSFGTAKIGGKTYVVLPSINGVEFWDFTDVNDIKQVKKLALPGVNAGDYENVAWQLWWQAPYLYVASAGRGIFIVDAADPANAVVANRGAGKPNPVPTGELGNFRIGPIFTMGNHMVLTAMESNGGFASLDISDPLNPKVLDSIVGTTPFYYATCFDGRNLHVSTRGSGAKMYSYDLSDRSRFVAEDNRLVIDEQLYCATQDNYVIQGAQTRIHKVDVSNPLNHVEVGRGSILREDDPNYSHSDNGQVAMFGNLVFVGNDHGSGSGFVVHAVDPDTTRPEVKQVSPANGAKQQALSSRIGLGMTDNIRPESVNANTFIVRPVGGNTLAGTYSVQLGIINFHPEQPLQPGTSYEVFLPANGVKDYAGNAIGADFKSTFNTGNATDINLQHYWTLAGNLSDPIGSNNGTPASGDTFESIGMSFANRTAGVPLKNDSVATVLGGTASLSFYMKTTQAGSANPWTAPGIFGRDQASGADDVFWGWIDGSGFMNLSVANKAANNPGTRSLAAVNDGNWHHVVMTRDAASGAQAMYVDGVKTSSTGLTGTKGLANKFQVMGQIQGNADLFKGTLAEVRVYSRVLTDGEVATLRGQAIIGDPGIGGGPKIVNGQLVFDPATLGSSGAQFRWNFGDGTRTAYSTQPRYTYTYTRPGHYTVTLTVRDASGRETFYTYNLTVIVPVTARAPTHTTNIAGDANSVYSLNPDSGTVAAVDAQTLAKRWEVRVGDEPKTLAVGPDGRIWVAVQGEDKLVALSAADGSLSATVPLAYGSGPYGVAFTPDGAKGLLTLESKSVLMSFDPSNGATTGAVALEGSLRGIAVSSDAQVAYVTRFKSKLTGGQLHKVNLQSMSAMPTIALPVDTTTVDTESRARGVANYLSQVVISPDGRRAVLPSKKDNIVRGRFRDGVDLTHDQSVRSILSQVDLQAAAEVFGEQIDFDDRAPARAALFSPPGDYLFVAQMEGNRVAIVDPYSRAVRGEINASSAPHGLYLDAARKRLFVNNFLARSVSVHDVSLVLSSESAAATFLQNVATVAQEPMAAAALRGKQVFYNASDRRMSKDNYISCASCHADGGDDGMVWDFTQRGEGLRRTISLMGRRGAGHGKMHWTANFDEVQDFENDIRNEFGGTGFLTNADFAATADPLGAPKAGKSAQLDDLAAYLSSLNKYMRSPARAADGSLSVEAARGQTVFNTAQCATCHTGGTFRDGLRHDVGTIQLSSGKGHNQPLAGLGFDTPTLSGTWNITAFFHNGQAATLQDVLNSGHGNASSLPPADVVALREYVRSLDTAPAVVTRLRSDLNPTMCVNIKGGATASGTVAVQWPCGTASNEKFTVTSVAGGYVQLVAEHSGLCLAQNGTATTNAPVVQLACTVGSTAQWSLVGGTLRNRASGSCLDVPNGSTTQDTALITWTCNGGNNQNWTQLP

SEQ ID NO: 3828 - protein, 1577 aa, Variovorax sp.
MKIRYFLMAFLAPLVTLLTHAAITGVSPMTTLGNMATAVSEAVADPLPLQGPGLGNLSYTSAELFKPVSMITSLAHPLDPAHSSAYESREVPATYPGRKDYGMNAGIMVNGYFLTSFAPDSGLGPGGFLLYDVSNPRQIRLVKKIYEPDDATGGRTKEFRETHSFGTAKIGGKTYVVLPSINGVEFWDFTDVNDIKQVKKLALPGVNAGDYENVAWQLWWQAPYLYVASAGRGIFIVDAADPANAVVANRGAGKPNPVPTGELGNFRIGPIFTMGNHMVLTAMESNGGFASLDISDPLNPKVLDSIVGTTPFYYATCFDGRNLHVSTRGSGAKMYSYDLSDRSRFVAEDNRLVIDEQLYCATQDNYVIQGAQTRIHKVDVSNPLNHVEVGRGSILREDDPNYSHSDNGQVAMFGNLVFVGNDHGSGSGFVVHAVDPDTTRPEVKQVSPANGAKQQALSSRIGLGMTDNIRPESVNANTFIVRPVGGNTLAGTYSVQLGIINFHPELPLSPGTSYEVFLPANGVKDYAGNAIGADFKSTFNTGNATDINLQHYWTLAGNLSDPIGSNNGTPASGDTFESIGMSFANRTAGVPLKNDSVATVLGGTASLSFYMKTTQAGSANPWTAPGIFGRDQASGADDVFWGWIDGSGFMNLSVANKAANNPGTRSLAAVNDGNWHHVVMTRDAASGAQAMYVDGVKTSSTGLTGTKGLANKFQVMGQIQGNADLFKGTLAEVRVYSRVLTDGEVATLRGQAIIGDPGIGGGPKIVNGQLVFDPATLGSSGAQFRWNFGDGTRTAYSTQPRYTYTYTRPGHYTVTLTVRDASGRETFYTYNLTVIVPVTARAPTHTTNIAGDANSVYSLNPDSGTVAAVDAQTLAKRWEVRVGDEPKTLAVGPDGRIWVAVQGEDKLVALSAADGSLSATVPLAYGSGPYGVAFTPDGAKGLLTLESKSVLMSFDPSNGATTGAVALEGSLRGIAVSSDAQVAYVTRFKSKLTGGQLHKVNLQSMSAMPTIALPVDTTTVDTESRARGVANYLSQVVISPDGRRAVLPSKKDNIVRGRFRDGVDLTHDQSVRSILSQVDLQAAAEVFGEQIDFDDRAPARAALFSPPGDYLFVAQMEGNRVAIVDPYSRAVRGEINASSAPHGLYLDAARKRLFVNNFLARSVSVHDVSLVLSSESAAATFLQNVATVAQEPMAAAALRGKQVFYNASDRRMSKDNYISCASCHADGGDDGMVWDFTQRGEGLRRTISLMGRRGAGHGKMHWTANFDEVQDFENDIRNEFGGTGFLTNADFAATVDPLGAPKAGKSAQLDDLAAYLSSLNKYMRSPARAADGSLSVEAARGQTVFNTAQCATCHTGGTFRDGLRHDVGTIQLSSGKGHNQPLAGLGFDTPTLSGTWNTAAFFHNGQAATLQDVLNSGHGNASSLPPADVVALREYVRSLDTAPAVVTRLRSDLNPTMCVNIKGGATASGTVAVQWPCGTASHEKFTVTSVTGGYVQLVAEHSGLCLAQNGTATTNAPVVQLACTVGNTAQWSLAVGTLRNRASGSCLDVPNGSTTQDTALITWTCNGGNNQNWTQLP

SEQ ID NO: 3829 - protein, 1573 aa, Variovorax sp.
MKIRYFLMAFLAPLVTLLTHAAITGVSPMTTLSNMATAVSEAVADPLPVQGPGLGNLTYTSAELFKPVSMITSAAHPLDPAHSSAYESREVPATYPGRKDYGMNAGIMVNGYFLTSFAPDSGLGPGGFLLYDVSNPRQIRLVKKIYEPEGRTQEFRETHSFGTAKIGGKTYVVLPSINGVEFWDFTDINDIKQVKKLALPGVNAGDYENVAWQLWWQAPYLYVASAGRGMFIVDAKDPANAVVANRGAGKPNPVPTGELGGFRIGPIFTMGNHMVLTAMESNGGFASLDISDPLNPKVLDSIVGTTPFYYATCFDGRNLHVSTRNSGARMYSYDLSDRSRFVAEDNRLVIDEQLYCATQDNYVIQGAQTRIHKVDVSNPLNHVEVGRGSILREDDPNFSHSDNGQVAMFGNLVFVGNDHGSGSGFIVHAVDPDTTKPEVKQVSPANGAKQQALTSRIGVGMTDNIRPESVNANTFVVRAVGGNTLAGTYSVQLGIINFFPDQPLSPGTSYEVFLPANGVKDYAGNAIGTDFKSVFNTGNATDINLQHYWTLAGNLSDQIGSNNGTPASGDAFESIGMNFAARTAGVPLKNDTVATVLGGTASLSFYMKTTQAGSANPWTAPGIFGRDQPSGADDVFWGWIDNSGFMNLSVANKAANNPGTRSPAAVNDGNWHHVVMTRDAASGAQAMYVDGVKTSSTGLTGTKGLANKFQVMGQIQGNTDLFKGTLAEVRVYSRVLTDTEVATLRGQTIIGDPGIGGGPKIVNGQLVFDPATLGSSGAQFRWNFGDSTQTAYSTQPRYTYTYSRPGHYTVTLTVRDASGRESFYTYNVTVIAPVTARPPTHTTNITGDANAVYSVNPDSGTVASIDAQTLAKRWETRVGDEPKTLAVGPDGRIWVTVQGEDKLVALSAADGSLSVTVPLAYGSGPYGVAFTPDGAKGLLTLESKSVLMSFDPSNGATTGAVALEGTLRGIAVNSDSQVAYVTRFKSKMTGGQLHKVNLQNMSAMATIALPVDTTTVDTESRARGVANYLSQVVISPDGKRAVLPSKKDNIVRGKFRDGNNLVHDQTVRSILSQVNLQSAAEVFAEQIDFDDRAPARAALFSPSGDYLFVAQMEGNRVAIVDPYSRAVRGEINASSAPHGLYLDAVRKRLFVNNFLARSVSVHDVASVLSSESAAPIFLQNVATVAQEPMAAAALRGKQVFYNASDRRMSKDNYLSCASCHADGGDDGMVWDFTQRGEGLRRTISLMGKRGASHGKMHWTANFDEVQDFENDIRNEFGGTGFLSNADFAATSDPLGAPKAGKNAQLDDLAAYLSSLNKYMRSPARAADGSLSVDAARGQALFTSAQCATCHSGGTFRDGLRHDVGTIQASSGKGMNQPLAGVGFDTPTLSGTWNTTAFFHNGQAATLQDVLTSGHGNANSLPAADQVAIREYVRSQDTAPAVVTRVRSDLNPTMCVNIKGVSTTSGATAVQWPCGNASNEKFTVNSLTGGYVQFVAEHSGLCLAQNGTATTNAPVVQLACTAGNTTQWSLVGGTIRNRASGSCLDVPNGSTAQDTALITWTCNGGNNQNWTQLP

SEQ ID NO: 3830 - protein, 1569 aa, Variovorax sp.
MKIRYYLMALMVPFVTLLTHAAITGVSPMTTLGNMAAAVSEAVADPLPLQGPGLGNLTYTSAELFKPVSMITSAAHPLDPAHSSAYESREVPATYPGRKDYGMNAGIMINGYFLTSFAPDSGLGPGGFLLYDVSNPRQIQLVKKIYEPEARTKEFRETHSFGTAKIGGKTYVVLPSINGIEFWDFSDINDIKQVKKLALPGVNGGDYEDVAWQLWWQAPYLYVASAGRGIFIVDARDPANAVIANRGAGKPNPVPTGELGGFRIGPIFTMGNHMVLTAMESNGGFASLDISDPLNPKVLDSIAGTTPFYYATCFDGRNLHASARNSGARMYSYDLSDRSRFVAEDNRLVIDEMLYCATQDNYVIQGAQTRIHKVDVSNPLNHVEVGRGSILREDDPNFSHSDNGQVAMFGNLVFVGNDHGSGSGFIVHAVDPDTTKPEVKQVSPANGAKQQALTSRIGLGMTDNIRPESVNSNTFIVRPVGGNTLAGTYSVQLGIINFSPDQPLQPGTSYEVFLPANGVKDYAGNAIAADYKSTFNTGNATDINLMHYWTLAGNLSDQIGSNNGTPVAGDAFESIGLNFANRTAGVPLKNDSVATVLGGTASLSFYMKTTQAGGANSWTAPGIFGRDQASGTDDVFWGWLDNGGRIKLSAGNDAGTTSTAAVNDGTWHHVVLTREAASGAQAVYVDGVKTTSTGPTGNKGLTNKFSVLGQIQGNAALFKGTLAEVRVYSRVLSDTEVNTLRSQAIIGDPGIGGGPKLVNGQLVFNPGTLGSSGAQFRWNFGDGTQTAYSNQPNYTYTYNRPGHFTVTLTVKDVNGRETFYTYNLTVIAPVTARAPTHTTNIAGDANSVYSVNPDSGTVAAIDAQTLAKRWETRVGDEPKTLAVGPDGRIWVTVQGEDKLVALSAADGSLSTTVPLAYGSGPYGVAFTPDGAKGLLTLESKSVLMSFDPSNGSTTGAVALEGNLRGIAVNADSQVAYVTRFKSKMTGGQLHKVNLQGMSAMTTIALPVDTATVDTESHARGVANYLSQVVISPDGTRAVLPSKKDNIVRGKFRDGLALEHDKTVRSILSQVNLQTAAEVFAEQIDFDDRAPARAALFSPSGDYLFVAQMEGNRVAIVDPYSRAVRGEINTSSAPHGLYLDATRKRLFVNNFLARSVSVHDVASVLSSETAAAIFLQNVATVAQEPMAAAALRGKQVFYNASDRRMSKDNYISCASCHADAGDDGMVWDFTQRGEGLRRTISLQGRRGLGHGKLHWTANFDEVQDFENDIRNEFGGTGFLTNADFAATSDPLGAPKAGKNAQLDDLAAYLSSLNKYMRSPARNADGSLSVDAARGQALFTSAQCVTCHAGGTFRDGIRHDVGTIQASSGKGMNQPLAGIGFDTPTLSGTWNTAAFFHNGQAATLQDVLGSGHGNANSLPAADVVAIREYVRSQDTAPAVISRIRSDLNPTLCVNIKGAATTSGATAVQWPCGTAGNEKFTVTSLPGGYVQFVAEHSGLCLAQNGTATTNAPVVQLACTAGNAAQWSMVGGSIRNRASGSCLDVPNSSTAQDTALITWTCNGGNNQNWTQLP

SEQ ID NO: 3831 - protein, 1569 aa, Variovorax sp.
MKIRYYVMALMVPFVTLLTHAAITGVSPMTTLGNMATAVSAAVADPLPLQGPGLGNLTYTSAELFKPVSMITSPNHPLDPAHSSAYESREVPATYPGRKDYGMNAGIMVNGYFLTSFAPDSGLGPGGFLLYDVSNPRQIQLVKKIYEPEARTKEFRETHSFGTAKIGGKTYVVLPSINGVEFWDFTDINDIKQVKKLALPGVNAGDYENVAWQLWWQAPYLYVASAGRGMFIVDARDPANAVVANRGAGKPNPVPTGELGGFRLGPIFTMGNHMVLTAMESNGGFASLDISDPLNPKVLDSIVGTTPFYYATCFDGKNLHVSTRNSGAKMYSYDLSDRSRFVAEDNRLVIDEQLYCATQDNYVIQGAQTRIHKVDVSNPLNHVEVGRGSILREDDPNFSHSDNGQVAMFGNLVFVGNDHGSGSGFVVHSVDPDITKPEVKQVSPASGAKQQALTSRIGLGMTDNIRPESVNANTFIVRPVGGNTLAGTYSVQLGIVNFHPEQPLLPGTSYEVFLPANGLKDYAGNAIAADYRSTFNTGNATDINLMHYWTLAGNLSDQIGNNGGTPAAGDAFESIGMNFANRTAGVPLKNDSVATVLGGTASLSFYMKTTQAGGPNSWTAPGIFGRDQSGGADDVFWGWLDSNGRIKLSVGNDGGTTSTAVVNDGNWHHVVLTRDAASGAQAVYVDGVKTTSAGLTGTKGLANKFNVLGQIQGNAALFKGTLAEVRVYGRVLSDTEVNTLRGQAIIGDPGIGGGPKLVNGQLVFNPGTLGSGGAQFRWNFGDGTQTAYSNQPNYTYTYTRPGHFTVTLTVKDANGRETFYTYNLTVIVPTTARAPTHTTNIAGDANSVYSVNPDSGTVAAIDAQTLAKRWEVRVGEEAKTLAVGPDGRVWVTVQGEDKLVALNAADGSVSATVPLAYGSGPYGVAFTPDGAKGLLTLESKSVLMSFDPSNGATTGAVALEGNLRGIAVSSDAQVAYVTRFKSKMTGGQLHKVNLQSMSAMTTIALPVDTTTVDTESRARGVANYLSQVIISPDGTRAVLPSKKDNIVRGKFRDGNNLVHDQTVRSILSQVNLQTAAEVFGEQIDFDDRAPARAALYSPSGDYLFVAQMEGNRVAIVDPYSRSVRGEINASSAPHGLYLDAARKRLYVNNFLARSVSVHDVASVLASETAAPIFLQNVSTVAQEPMSPAALRGKQVFYNASDRRMSKDNYISCASCHADAGDDGMVWDFTQRGEGLRRTISLMGKRGLGHGKLHWTANFDEVQDFENDIRNEFGGTGFLSNADFTATQDPLGAPKAGKNAQLDDLAAYLTSLNKYMRSPARNADGSLSVDAARGQALFASAQCVTCHTGATFRDGQRHDVGTIQLSSGKGSNQPLAGVGFDTPTLVGTWNTSAFFHNGQAATLQDVLASGHGNASSLPAADVVAIREYVRSQDTDPTPTITRIRSNLSNLCVNIKGVSTASGATAVQWPCGNANNERFTVTNLTGGYVQFKAEHSGLCLAQSGTATTNAAVVQLACSAGDTTQWSLAGGAIKNRASGSCLDVPNSSTTQDTALITWTCNGGTNQSWTQLP

SEQ ID NO: 3832 - protein, 1569 aa, Variovorax sp.
MKIRYYVMALMVPFVTLLTHAAITGVSPMTTLSNMATAVSEAVADPLPLQGPGLGNLTYTSAELFKPVSMITSPNHPLDPAHSSAYESREVPATYAGRKDYGMNAGIMVNGYFLTSFAPDSGLGPGGFLLYDVSNPRQIQLVKKIYEPEARTKEFRETHSFGTAKIGGKTYVVLPSINGVEFWDFTDINDIKQVKKLALPGVNSGDYENVAWQLWWQAPYLYVASAGRGMFIVDARDPANAVVANRGAGKPNPVPTGELGGFRLGPIFTMGNHMVLTAMESNGGFASLDISDPLNPKVLDSIVGTTPFYYATCFDGRNLHVSTRNSGAKMYSYDLSDRSRFVAEDNRLVIDEQLYCATQDNYVIQGAQTRIHKVDVSNPLNHVEVGRGSILREDDPNFSHSDNGQVAIFGNLVFVGNDHGSGSGFVVHAVDPDIVKPEVKQVSPANGAKQQALTSRIGLGMTDNIRPESVNSNTFIVRPVGGNTLAGTYSVQLGIVNFHPEQPLQPGTSYEVFLPANGLKDYAGNAIGADYRSTFNTGNATDINLMHYWTLAGNLSDQIGNNSGTPASGDAFESIGMNFANRTAGVPLKNDGVATVLGGTASLSFYMKTTQAGGANSWTAPGIFGRDQPSGADDVFWGWLDSNGRIKLSVGNDGGTASTAAVNDGNWHHVVLTRDAASGAQAVYVDGVKTTSAGLTGTKGLANKFSVLGQIQGNTALFKGTLAEVRVYGRVLSDTEVNTLRGQAIIGDPGIGGGPKLVNGQLVFNPGTLGSSGAQFRWNFGDGTQTAYSNQPNYTYTYTRPGHFTVTLTVKDANGRETFYTYNLTVIVPTTARAPTHTTNIAGDANSVYSVNPDSGTVAAINSETLAKRWEVRVGDEAKTLAVGPDGRIWVTVQGEDKLVALNAADGSVSATVPLAYGSGPYGVAFTPDGAKGLLTLESKSVLMSFDPSNGATTGAVALEGNLRGIAVSGDAQVAYVTRFKSKMTGGQLHKVNLQSMSAMPTIALPVDTTTVDTESRARGVANYLSQVIISPDGTRAVLPSKKDNIVRGKFRDGINLSHDQTVRSILSQVNLQTAAEVFAEQIDFDDRAPARAALYSPSGDYLFVAQMEGNRVAIVDPYSRSVRGEINASSAPHGLYLDAARKRLFVNNFLARSVSVHDVASVLASETAAPVFLQNVSTVAQEPMAAAALRGKQVFYNASDRRMSKDNYISCASCHADAGDDGMVWDFTQRGEGLRRTISLMGRRGLGHGKLHWTANFDEVQDFENDIRNEFGGTGFLSNADFTATQDPLGAPKAGKNAQLDDLAAYLTSLNKYMRSPARNADGSLSVDAARGQALFASAQCVTCHTGATFRDGQRHDVGTIQLSSGKGMNQPLAGVGFDTPTLLGTWNTTAFFHNGQAATLQDVLAGGHGNASSLPPADVVAIREYVRSQDSDPTPTITRIRSNLSNLCVNIKGVSTTSGATAVQWPCGTASNEKFTVTSLTGGYVQFKAEHSGLCLAQSGTATTNAAVVQLACSAGDTTQWSLVGGTIKNRASGSCLDVPNASTAQDTALITWTCNGGTNQSWTQLP

SEQ ID NO: 3833 - protein, 1569 aa, Variovorax sp.
MKIRYYVMALMVPFVTLLTHAAITGVSPMTTLSNMATAVSEAVADPLPLQGPGLGNLTYTSAELFKPVSMITSPNHPLDPAHSSAYESREVPATYAGRKDYGMNAGIMVNGYFLTSFAPDSGLGPGGFLLYDVSNPRQIQLVKKIYEPEARTKEFRETHSFGTAKIGGKTYVVLPSINGVEFWDFTDINDIKQVKKLALPGVNSGDYENVAWQLWWQAPYLYVASAGRGMFIVDARDPANAVVANRGAGKPNPVPTGELGGFRLGPIFTMGNHMVLTAMESNGGFASLDISDPLNPKVLDSIVGTTPFYYATCFDGRNLHVSTRNSGAKMYSYDLSDRSRFVAEDNRLVIDEQLYCATQDNYVIQGAQTRIHKVDVSNPLNHVEVGRGSILREDDPNFSHSDNGQVAIFGNLVFVGNDHGSGSGFVVHAVDPDIVKPEVKQVSPANGAKQQALTSRIGLGMTDNIRPESVNSNTFIVRPVGGNTLAGTYSVQLGIVNFHPEQPLQPGTSYEVFLPANGLKDYAGNAIGADYRSTFNTGNATDINLMHYWTLAGNLSDQIGNNSGTPASGDAFESIGMNFANRTAGVPLKNDGVATVLGGTASLSFYMKTTQAGGANSWTAPGIFGRDQPSGADDVFWGWLDSNGRIKLSVGNDGGTASTAAVNDGNWHHVVLTRDAASGAQAVYVDGVKTTSAGLTGTKGLANKFSVLGQIQGNTALFKGTLAEVRVYGRVLSDTEVNTLRGQAIIGDPGIGGGPKLVNGQLMFNPGTLGSSGAQFRWNFGDGTQTAYSNQPNYTYTYTRPGHFTVTLTVKDANGRETFYTYNLTVIVPTTARAPTHTTNIAGDANSVYSVNPDSGTVAAINSETLAKRWEVRVGDEAKTLAVGPDGRIWVTVQGEDKLVALNAADGSVSATVPLAYGSGPYGVAFTPDGAKGLLTLESKSVLMSFDPSNGATTGAVALEGNLRGIAVSGDAQVAYVTRFKSKMTGGQLHKVNLQSMSAMPTIALPVDTTTVDTESRARGVANYLSQVIISPDGTRAVLPSKKDNIVRGKFRDGTNLSHDQTVRSILSQVNLQTAAEVFAEQIDFDDRAPARAALYSPSGDYLFVAQMEGNRVAIVDPYSRSVRGEINASSAPHGLYLDATRKRLYVNNFLARSVSVHDVASVLASETAAPVFLQNVSTVAQEPMAAAALRGKQVFYNASDRRMSKDNYISCASCHADAGDDGMVWDFTQRGEGLRRTISLMGRRGLGHGKLHWTANFDEVQDFENDIRNEFGGTGFLSNADFTATQDPLGAPKAGKNAQLDDLAAYLTSLNKYMRSPARNADGSLSVDAARGQALFASAQCVTCHTGATFRDGQRHDVGTIQLSSGKGMNQPLAGVGFDTPTLVGTWNTTAFFHNGQAATLQDVLAGGHGNASSLPPADVVAIREYVRSQDSDPTPTITRIRSNLSNLCVNIKGVSTTSGATAVQWPCGTASNEKFTVTSLTGGYVQFKAEHSGLCLAQSGTATTNAAVVQLACSAGDTTQWSLVGGAIKNRASGSCLDVPNASTAQDTALITWTCNGGTNQSWTQLP

SEQ ID NO: 3834 - protein, 1573 aa, unknown
  environmental sample
MKIRYYVMALMAPLVTLLTHAAITGVSPMTTLNNMATAVSAAVADPLPLQGPGLGNLTYTSAELFKPVSMITSPNHPLDPAHSSAYESREVPATYPGRKDYGMNAGIMVNGYFLTSFAPDSGLGPGGFLLYDVSNPRQIKLVKKIYEPDDATGGRTKEFRETHSFGTAKIGGKTYVVLPSINGVEFWDFTDINDIKQVKKLALPGVNAGDYENVAWQLWWQAPYLYVASAGRGMFIVDARDPANAVVANRGAGKPNPVPTGELGGFRLGPIFTMGNHMVLTAMESNGGFASLDISDPLNPKVLDSIVGTTPFYYATCFDGRNLHVSTRNSGAKMYSYDLSDRSRFVAEDNRLVIDEQLYCATQDNYVIQGAQTRIHKVDVSNPLNHVEVGRGSILREDDPNFSHSDNGQVAMFGNLVFVGNDHGSGSGFVVHSVDPDITKPEVKQVSPANGSKQQALTSRIGLGMTDNIRPESVNSNTFIVRPVGGNTLAGTYSVQLGIVNFHPEQPLQPGTSYEVFLPANGLKDYAGNAIGADYRSTFNTGNATDINLMHYWTLAGNLSDQIANNNGTPATGDAFESIGLNFANRTAGVPLKNDSVATVLGGTASLSFYMKTTQAGGPNSWTAPGIFGRDQSGGADDVFWGWLDSNGRIKLSVGNDGGTTSTAAVNDGNWHHVVLTRDAASGAQAVYVDGVKTTSTGLTGTKGLANKFNVLGQIQGNTAMFKGTLAEVRVYGRVLSDTEVNTLRGQAIIGDPGIGGGPKLVNGQLVFNPGTLGSSGAQFRWNFGDGTQTAYSNQPNYTYTYTRPGHFTVTLTVKDANGRETFYTYNLTVIVPTTARPPTHTTNIAGDANSVYSVNPDSGTVAAINSETLAKRWEVRVGEEPKTLAVGPDGRIWVTVQGEDKLVALNAADGSVSATVPLAYGSGPYGVTFTPDGAKGLLTLESKSVLMSFDPSNGSTTGAVALEGNLRGIAVNSDAQVAYVTRFKSKMTGGQLHKVNLQSMSAMTTIALPVDTTTVDTESRARGVANYLSQVIISPDGMRAVLPSKKDNIVRGKFRDGNNLVHDQTVRSILSQVNLQTAAEVFAEQIDFDDRAPARAALFSPSGDYLFVAQMEGNRVAIVDPYSRSVRGEINASSAPHGLYLDAARKRLFVNNFLARSVSVHDVASVLASETAAPIFLQNVSTVAQEPMSPAALRGKQVFYNASDRRMSKDNYISCASCHADAGDDGMVWDFTQRGEGLRRTISLMGKRGLGHGKLHWTANFDEVQDFENDIRNEFGGTGFLSNADFAATSDPLGAPKAGKNAQLDDLAAYLTSLNKYMRSPARNADGSLSVDAARGQALFASAQCVTCHTGATFRDGQRHDVGTIQLSSGKGMNQPLAGVGFDTPTLLGSWNTAAFFHNGQAATLQDVLASGHGNASSLPPADVVAIREYVRSQDSDPTPTITRIRSNLSNLCVNIKGVSTASGATAVQWPCGNANNERFTVTSLTGGYLQFKAEHSGLCLAQSGTATTNAAVVQLACSAGDTTQWSLVGGAIKNRASGSCLDVPNSSTTQDTALITWTCNGGTNQSWTQLP

SEQ ID NO: 3835 - protein, 1568 aa, unknown
  environmental sample
MKIRYYLMAFLLPFVTLLTHAAITGVSPMTTLSNMATAMAEAVADPLPLQGPGLGNLTYTSAELFKPVSMITSAAHPLDPAHSNAYESREVPATYPGRKDYGMNAGIMINGYFLTSFAPDSGLGPGGFLLYDISNPRQIKLVKKIYEPEGRTQEFRETHSFGTAKIGGKTYVTLPSINGIEFWDFTDVNDIKQVKKLALPGVNGGDYENVAWQLWWQAPYVYVASAGRGIFIVDASDPANAVVANRGANKPNPVPTGELGGFRVGPIFTIGNHMVLSSMDNTAGFSSLDISDPLNPKVLDAIGSNPNYYATCFDGKTLHASARGGGAKMYSYDLSDRSKFVAEDNRLVVDEQLYCATQDSYVFQGAQTRIHKVDVSNPLNHVEVGRGSILREDDPNFSHSDNGQVAVFGNLVFVGNDHGSGSGFIVHQVDPDTTKPEVRQVSPANNAKQQALTSRIGLGMSDSILPESVNSNTFIVRPVGGNTLAGTYSVQLGIINFHPAQPLQPGTSYEVFLPANGVKDYAGNAIAADYKSVFHTGNAAEIGLMHYWTLAGNLSDQIGANNGTPATGDAFESIGLNFANRTVGVTLKSDGVATVLGGSASVSLYMKTTQAGGANSWTAPGIFGRDQPSGADDVFWGWLDNGGRIKLSVGNDAGTVSTAAVNDGNWHHVVMTRDAASGAQALYVDGVKTTSTGPTGNKGLSNKFAVLGQIQGNTALFKGTLAEVRVYGRVLSDTDVSTLRSQAIIGDPGIGGGPKLVNGQLVFNPATLGSSGAQYRWNFGDGTQTAYSNQPNYTYTYTRPGHFTVTLTVKDASGRETFYTYNLTVIMPVTPNAPTHSTNIAGDANSVYSVNPDSGTVAAIDSQSLVKRWEVRVGDEPKTLAVGPDGRIWVTVQGEDKLVALNAADGSLSATVPLAYGSGPYGVAFTPDGTKGLLTMESKSILMSFNPSTGATTGAVALDGALRGIAVESGSQVAYVTRFKSKMTGGQLHKVNLQSMSAMSTIALPVDTTTIDTENRARGVANYLSQVVISPDGARAVLPSKKDNIVRGKFRDGNNLVHDQTVRSILSQVNLQTAAEVFAEQIDFDDRAPARAALFSPSGDYLFVAQMEGNRVAIVDPYSRAVRGEINASSAPHGLYLDAVRKRLFVNNFLARSVTVHDVASVLSSESNVPTFLQTVSTVAAEPMSAAALRGKQVFYNASDRRMSKDNYISCASCHADGGDDGMVWDFTQRGEGLRRTISLQGRRGLGHGKLHWTANFDEVQDFENDIRNEFGGLGFLTNADFAATSDPLGAPKAGKSAQLDDLAAYLSSLTKYMRSPARAADGSLSVDAARGQTVFNTAQCATCHTGATFRDGVRHDVGTIQASSGKGLNQPLAGVGFDTPTLLGTWNTTAFFHNGQAATLQDVLTSGHGNASSLPANDVVALREYVRSLDNDPTPVVSRIRSNHSNLCVNVRGASTASGATVVQWPCGNDGNERFTMTQTNDGFVQFKVEHSGLCLAQSGTATTNAAVVQLACSAGTTTQWSLVGSTLRNRASGSCLDVPNNATTQDTALITWTCNGGNNQNWTQLQ

SEQ ID NO: 3836 - protein, 1571 aa, Variovorax sp.
MKIRYYLMALMVPFVTLLTHAAITGVSPMTTLGNMATAVSEAVADPLPLQGPGLGNLTYTSEELFKPVSMITSPAHPLDPAHSNAYESREVPATYPGRKDYGMNAGIMVNGYFLTSFAPDSGLGPGGFLLYDVSNPRQIKLVKKIYEPEARTKEFRETHSFGTAKIGDKTYVVLPSINGVEFWDFTDVNDIKQVKKLALPGVNGGDYENVAWQLWWQAPYLYVASAGRGIFIVDAADPANAVLANRGAGKSNPVSTGELGGFRIGPIFTMGNHMVLTAMESNGGFASLDISDPLNPKVLDSIVGSTPFYYATCFDGRNLHVSTRNSGAKMYSYDLSDRSKFVAEDNRLVIDEQLYCATQDHYVIQGAQTRIHKVDVSNPLNHVEVGRGSILREDDPNFSHSDNGQVAMFGNLVFVGNDHGSGSGFVVHQVDPDTTRPEVKQVSPANGAKQQALTSRIGLGMTDNIRPESVNANTFIVRPVGGNTLAGTYSVQLGIVNFHPTQPLQPGTSYEVFLPANGVKDYAGNAIGADFKSTFNTGNAAEVGLSYHWALNGKLSDPISNNDGTPASGDAFESIGLNFANRAGGVQLKNDSVATVLGGTASLSFYMKTTQNGSANAWTAPGIFGRDQSGGADDVFWGWLDNTGRLNLSVANAATNNPGTRSTSPVNDGNWHHVVLTRDAGSGAQTMYIDGAKTSSTGLTGVKGLANKFQWLGQIQGNADFFKGTLADVRVFSRVLGDAEVATLRGQAVIGDPGIGSGPKVVNGALNFNPATLGSGGAQFRWNFGNGTVTAFSSQAGYSYTYTTPGHYTVTLTVKDSAGRETYYTYNVTIIAPVTASAPRHTGNIAGDANRVYAVNPDSGTVAAIDAQSLAKLWEVSVGSEAKTLALGPDGRVWVAVQGEDKLVALNAADGSVSVTVPFDYGSGPYGVVFTPDGTKGLLTLESKSRLVSFNPSTGAVTATLPLDGTVRGIAVTGDAQIAYVTRFKSKMTGGELYKVNLASMSTLPTIALPVDTTTIDTEAGARGVANYLSQVVISPDGKRAILPSKKDNIVRGRFRDGKDLVHDQTVRSILSQVDLQSAAHVAGEQIDFDDRAPARAALFSPAGDYIFVAQMEGNRVAIVDSYTRSVRGEIDTSSAPHGLFLDAARKRLFVNNFLARSVSVHDVAAVLASESNAATFLRNVQTVATEPLAAAALRGKQVFYNAADRRMSKDNYISCASCHADGGDDGMVWDFTQRGEGLRRTISLQGRRGTSHGKLHWTANFDEVQDFENDIRNEFGGTGFLSNADYAATSNPLGTPKAGRNAQLDDLAAYLSSLDKFMRSPARTADGNLSVEAARGQTVFNTAQCATCHTGGTFRDGQRHDVGTIQLSSGKGSNQPLAGVGFDTPTLSGTWSVTSFFHNGQAASLQAVLDSGHGNANGLPPADVVALREYVRSLDTAPPLVARIRSDSSNLCVNIKGVSTASGATAVQWPCGNDANEKFTVTSSGGYVQFVAQHSGLCLAQSGNATTNAAVVQLACTAGNATQWTVVGSTLRNRASGSCLDVPNGSTTQDTALITWTCNGGNNQNWTQLP

SEQ ID NO: 3837 - protein, 1571 aa, Variovorax sp.
MKIRYYLMALMVPFVTLLTHAAITGVSPMTTLGNMATAVSEAVADPLPLQGPGLGNLTYTSEELFKPVSMITSPAHPLDPAHSNAYESREVPATYPGRKDYGMNAGIMVNGYFLTSFAPDSGLGPGGFLLYDVSNPRQIKLVKKIYEPEARTKEFRETHSFGTAKIGDKTYVVLPSINGVEFWDFTDVNDIKQVKKLALPGVNGGDYENVAWQLWWQAPYLYVASAGRGIFIVDAADPANAVLANRGAGKSNPVSTGELGGFRIGPIFTMGNHMVLTAMESNGGFASLDISDPLNPKVLDSIVGSTPFYYATCFDGRNLHVSTRNSGAKMYSYDLSDRSKFVAEDNRLVIDEQLYCATQDHYVIQGAQTRIHKVDVSNPLNHVEVGRGSILREDDPNFSHSDNGQVAMFGNLVFVGNDHGSGSGFVVHQVDPDTTRPEVKQVSPANGAKQQALTSRIGLGMTDNIRPESVNANTFIVRPVGGNTLAGTYSVQLGIVNFHPTQPLQPGTSYEVFLPANGVKDYAGNAIGADFKSTFNTGNAAEVGLSYHWALNGKLSDPISNNDGTPASGDAFESIGLNFANRAGGVQLKNDGVATVLGGTASLSFYMKTTQNGSANAWTAPGIFGRDQSGGADDVFWGWLDNTGRLNLSVANAATNNPGTRSTSPVNDGNWHHVVLTRDAGSGAQTMYIDGAKTSSIGLTGVKGLANKFQWLGQIQGNADFFKGTLADVRVFSRVLGDAEVATLRGQAVIGDPGIGSGPKVVNGALNFNPATLGSGGAQFRWNFGNGTVTAFSSQAGYSYTYTTPGHYTVTLTVKDSAGRETYYTYNVTIIAPVTASAPRHTGNIAGDANRVYAVNPDSGTVAAIDAQSLAKLWEVSVGSEAKTLALGPDGRVWVAVQGEDKLVALNAADGSVSVTVPFDYGSGPYGVVFTPDGTKGLLTLESKSRLVSFNPSTGAVTATLPLDGTVRGIAVTGDAQIAYVTRFKSKMTGGELYKVNLASMSTLPTIALPVDTTTIDTEAGARGVANYLSQVVISPDGKRAILPSKKDNIVRGRFRDGKDLVHDQTVRSILSQVDLQSAAHVAGEQIDFDDRAPARAALFSPAGDYIFVAQMEGNRVAIVDSYTRSVRGEIDTSSAPHGLFLDAARKRLYVNNFLARSVSVHDVAAVLASESNAATFLRNVQTVATEPLAAAALRGKQVFYNAADRRMSKDNYISCASCHADGGDDGMVWDFTQRGEGLRRTISLQGRRGTSHGKLHWTANFDEVQDFENDIRNEFGGTGFLSNADYAATSNPLGTPKAGRNAQLDDLAAYLSSLDKFMRSPARTADGNLSVEAARGQTVFNTAQCATCHTGGTFRDGQRHDVGTIQLSSGKGSNQPLAGVGFDTPTLSGTWSVTSFFHNGQAASLQAVLDSGHGNANGLPPADVVALREYVRSLDTAPPLVARIRSDSSNLCVNIKGVSTASGATAVQWPCGNDANEKFTVTSSGGYVQFVAQHSGLCLAQSGNATTNAAVVQLACTAGNATQWTVVGSTLRNRASGSCLDVPNGSTTQDTALITWTCNGGNNQNWTQLP

SEQ ID NO: 3838 - protein, 1578 aa, unknown
  environmental sample
MSIKKVLAVGSLFCCALLTHAAITGVNPLDTIRKAATGMASAAADLMADPLPLQGPGMGNLTYTQAELFKPISRIYEESDTGAGAGIGGDVPKIPGGSVTHPTAGYTKYHYGQNVGLMINGYFLTTFAPDGGLGPGGFLLYDISDPRNIKLAKRIYEPDGRTKEFREPHAIGVANIGGKQYVAMPSVFGVEFWDFTDINDIKQVKKLVLPNVNKGDYGNVSWQLWWQAPYLYVAAAEQGIFIIDARDPANAVLANRGAGKPNPVPTGELGGFRVGPIFTMGNHMVLTSMTNTSGFASLDISDPLNPKVLDAVAGSTPNYYATCFDGKKVYASAQESGGKMFGYDLSDRSRFVAEDNRLVINQQLYCGTQDHYVFQGAQNYIHKVDVSNPLNHVEVGRGGLFVESDPHFSSSDHGQVSPFGNLVYVGNDHGSGSGFIVHAVAPDTTKPEVKQVSPANGAKQQALTSRIGLGMTDSIRPESVNSNTFIVRPVGGNTLAGTYSVQLGIVNFHPEQPLQPGTSYEVFLPANGLKDYAGNAIGADYRSTFNTGNASDINLMHHWPLTGNLGDQISANNGTPATGDAFESIGLNFANRTTGVQLKNDAVATTLGGTASLSFYMKTTQAGGASSWTAPGIFGRDQSPGVDDVFWGWLDSTGKIKLSVGDDAGTRSQAAVNDGNWHHVVLTRDAASGAQAVYVDGVKTTSTGPTGNKGLSTKFKVLGQIQGNTALFKGTLAEVRVYGRVLGDSDVAALREQAVIGDPGIAGAPKIVNGQLSFNPATLGSSGAQFRWNFGDGTQSAYATQPGVTHTYTRPGHYTVTLTVKAANGQETFYTYNLTVIAPVTALAPTHTTNIAGDANSVYSVNPDSGTVAAIDAQTLAKRWEVRVGEEPKTLAVGPDGRIWVAVQGDDKLVALNAADGSVSATVPLAYGSGPYGVVFTPNGAKGLLTLESKSMLMSFDPSNGSTTGTLALEGAVRGIAVDAGSQSAYVTRFKSKMTGGQLHKVNLQSLSGATTIALAVDTTTVDTEAAARGVPNYLSQVVISPDGARALLPSKKDNIVRGTFRDGLPLEHDKTVRSILSQVNLQTASEVFSEQIDFNDRAPARAALYSPSGDYIFVAQMEGNSVAIVDAYNRSVRGEINASSAPHGLYLDAARKRLFVNNFLARSVSVHDVASVLSSESAAAAFLQSVTTVAQEPMSPAALRGKQVFYNASDRRMSMNNYMSCASCHADAGDDGMVWDFTQRGEGLRRTISLQGRRGTGHGKLHWTANFDEVQDFEHDIRNEFGGTGFLSNADFSASGDPLGVPKAGRNAQLDDLAAYLNSLNKYMRSPARTADGNLSVDAVRGQTVFNTAQCATCHTAGSLRDGLRHDVGTIQLSSGKGSNQPLTGVGFDTPTLYGTWSNPTFFHNGQKATLQDVLTSGHGNASSLPAADLLALGEYVKSLDTAPAFDTRIRSEVSNLCVNVSGGSTASGATVVQWACGNGNNQTFTVNSSGGYSQFVAKHSGLCLAQGNTNTGGGPLVQLACTAGVATQWSVVGATLRNRVSPNACLDVPGSSTTQGTALSTYACHGGANQRWSQIP

SEQ ID NO: 3839 - protein, 1564 aa, unknown
  environmental sample
MKIRYLFTVILLGVVSLLTHAAITGVSPLTTLSNMASSAKTALVADALPLKGPGLGNLSYTSQELFKAVSMIHRDDQGVPETYPGRKAFGMNVGIMHNGYFLTTFAPDSGLGPGGFLLYDVSDPRAIKLVKRIYEPDPGGRTSEFREAHAIGTATIGGKDYIAVPSTKGVEFWDFTDINDIKQVKKLALPTVNGGDYANVNWQMWWQAPYLYVASANDGVYIVDASDPANAVLANRGAGKPNPVPVGELGGFRVGPIFTMGNHMVLTSMDNTAGFSSLDISDPLNPKVLDTVGSNPNYYATCFDGKSLHASARGGGAKMYSYDLSDRSNFVPEDNRLVIDEQLYCGTQDNFVFQGAQYRVHKVDVSNPLNHVEVGRGSLFAENDPEFSHSDHGQVAPFGNLVFVGNDHGSGSGFLVHSVDPDTTRPEVRQVSPASGAKQQALSSRIGIGLSDSILPETVNASTFIVRPVGGNALAGTYSVQLGIINFFPSQPLAAGTAYEVFLPAGGVKDYAGNAIAADYRSVFHTGNAEDIGLMHHWPLEGTLADTIGSNNGTTGSGDAFASIGLDFAQRTGGVPLKNDSVAATLGGTASLSFYMKTTQPGAANPWTAPGIFGRDQANGTDDVFWGWIDGSGRLNLSVGNQASNNPGTRSTAAVNDGNWHHVVMTRDAASGAQTLYVDGVKTSSTGLTGTKGLSNKFQVLGQIQGNADFFKGTLAEVRVYSRVLTDAQVAALRGQAVIGNPGIGSGPRYVNGQLVLNPDTLGSTGAQYRWNLGDGTQTAFSNSAGYTHTYSRPGHYTLTLTVRDASGRETYYTYNVTVVVPMTASKPTHSTNITGDASTVFAVNPDSGTVAAIDAQTLAKRWEVSVGSEPKTLALGPDGRLWVTVQGDDKLVALNAADGATSATIALAYGSGPYGVAFTPDGGKGLLTLESKSQLLSFDPATGATTGTLALQGDVRGIAVSADSQMAYVTRFKSKMDGGQLHKVNVQTMTTVKTVALPVDTATIDSESKARGVANYLSQVVISPDGARAVLPSKKDNIVRGRYRDGKDMVHDQTVRSILSQVDLVQASEVFAEQIDFDDRAPARAALFSPWGDYLFVAQMEGNRVAIVDTYTRAIRGEFNTSSAPHGLYLDATRKRLFVNNFLARSVSVHDVASVLSSETAAATFLASVGTVAQEPMSPAALRGKQVFYNAADRRMSKDNYISCASCHADGGDDGMVWDFTQRGEGLRRTISLQGRRGMDHGKLHWSANFDEVQDFENDIRNEFGGVGFLSNADFAATSDPLGAPKAGKSAQLDDLAAYLTSLNKYMRSPARNADGSLSVAAVRGQAVFASAQCATCHTGDTFRDGQRHDVGTIQPSSGKGMNQPLAGVGFDTPTLSGTWKNSSFFHNGQAATMQDVLAGGHGNASSLPAGDVAALGEYVRSLDAPHAVPDVVARLRSNHSNLCLNIRGASTASGALAVQWPCGTATNERFTFRTVSGGYVQLVAQHSGLCVAQNGTATSNAAVVQLACSAGPTTEWSMAGATLRNRASGSCMDVPNNSTAQDTALITWPCNGGNNQNWTQLP

SEQ ID NO: 3840 - protein, 1582 aa, Variovorax sp.
MSIKKVLAVGSLFCCAVLTHAAITGVNPLDTIRKAATGMASAAAGLMADPLPLQGPGFGNLTYAQAELFKPISTIHEVSDDGAGAGTGADVPKIPGGSVTHPTAGYTKYHYGQNVGLMLNGYFLTTFAPDGGLGPGGFLLYDISDPRNIKLAKRIYEPDGRTKEFREPHAIGIAHIGGKQYVAMPSVFGVEFWDFTDINDIKQVKKLVLPNVNKGDYGNVSWQLWWQAPYLYVAAAEQGIFIIDARDPANAVLANRGVGKPNPVPTGELGGFRVGPIFTMGNHMVLTSMTNTSGFASLDISDPLNPKVLDAVAGSTANYYATCFDGKKVYGSAQESGGKMFGYDLTDRSRFVAEDNRLVINQQLYCGTQDNYVFQGAQNYIHKVDVSNPLNHVEVGRGGLFVESDPHFSSSDHGQVSPFGNLIYVGNDHGSGSGFIVHALAPDTTKPEVKQVSPVNGARQQALTSRIGLGMTDSILPESVNANTFIVRPVGGNTLAGTYSVQLGIVNFHPEQPLQPGTSYEVFLPANGLKDYAGNAIGADYRSTFNTGNASDISLSHHWPLTGSLADQIGANNGTPATGDAFESIGLNFANRTTGVQLKNDTVATTLGGTASLSFYMKTTQAGSANSWTAPGIFGRDQSPGVDDVFWGWLDSTGKIKLSVGDDAGTRSQASVNDGNWHHVVLTRDAASGAQAVYVDGVKTTSTGPTGIKGLTARFKILGQIQGNTALFKGTLAEVRVYGRVLGDSDVAALREQAVIGDPGIAGAPKIVNGQLSFNPATLGSGGAQFRWNFGDGTQSAYATQPGVTHTYTRPGHYTVTLTVKAANGQETFYTYNLTVIAPVTALAPTHTTNIAGDANSVYSVNPDSGTVAAIDAQTLAKRWEVRVGEEPKTLAVGPDGRIWVAVQGEDKLVALNAADGSVSATVALAYGSGPYGVVFTPNGAKGLLTLESKSVLMSFDPSNGSTTGTLALEGAVRGIAVDAGSQSAYVTRFKSKMTGGELHKVNLQSLSGATTIALAVDTTTVDTEAAARGVPNYLSQVVISPDGARALLPSKKDNIVRGTFRDGLPLEHDKTVRSILSQVNLQTASEVFGEQIDFNDRAPARAALYSPSGDYIFVAQMEGNSVAIVDAYNRSVRGEINASSAPHGLYLDAARKRLYVNNFLARSVSVHDVASVLSSESAAPAFLQSVTTVAQEPMAAAALRGKQVFYNASDRRMSMNNYMSCASCHADAGDDGMVWDFTQRGEGLRRTISLQGRRGTGHGKLHWTANFDEVQDFEHDIRNEFGGTGFLSNADFSATGDPLGVPKAGKNAQLDDLAAYLNSLNKYMRSPARTADGNLSVDAVRGQTVFNTAQCATCHTAGTLRDGLRHDVGTIQLSSGKGSNQPLTGVGFDTPTLYGTWSNPTFFHNGQKATMQDVLAGGHGNASSLPAADLLALGEYVKSLDTAPAFDTRIRSEVSNLCVNVSGGSTASGATVVQWACGNGNNETFTVNSSGGYSQFVAKHSGLCLAQGNTSTGGGSLVQLACATAGVATLATQWSVVGATLRNRVSPNACLDVPGSSTTQGTALSTYACHGGANQRWSQIP

SEQ ID NO: 3841 - protein, 1558 aa, Acidovorax sp.
MKIRYYLMALLLPFATLLTHAAITGVNPMTTLTTMAAAVTQAAEVPLPLQGPGLGNLTYTSAELFKPVSMITRASGDVPATYPGRKDYGLNVGIMLNGYFLTSFAPDSGLGPGGFLLYDVSNPRAIVLVKKIYEPEGRTKEFREAHAFGTAKINGRQYVVVPSIKGIEFWDFTDINNIQQVKKLSLPTVNGGDYTNVAWQLWWQAPYVYVASANDGVYIVDASDPANAVIANRGAGKPNPVPTGELGGFRVGPIFTMGNHMVLSSMDNTDGFASLDISDPLNPKVLDTVGSNPNYYATCFDGRNLHASARGGGAKMYSYDLLDRTQFVVEDNRLVIDEQLYCGTQDHYVFQGAQFKVHKVDVSNPLNHVEVGQGSLFATNDPEYSHSDHGQVAPMGNLLFIGNDHGSGSGFIVHQTAPDTTPPAVKQTSPANGAKQQALTSRIGVGLTDSIRPESVNAATFIVRPVNGNALPGTYSVQLGIINFHPTQPLTAGTSYEIVLTAGGVKDYAGNGIAAEYKAVFHTGNATDISLMNHWPLSTTLTDEIGANNGTASAADQFASIGLNFAQRTGGVPLKNDGVATALGGTASLAFYMKTTQNGSANAWTAPGLFGRDQSGGADDVFWGWIDNTGRMNLSVGNVAANNPGTRSTAAVNDGNWHHVVMTRDAASGAQTLYIDGNKTSSTGLTGTKGLSNKFALLGQIQGNTDFFRGSLADVRVYGRVLSDADVTQLRSQAIIGDAGVSGGPQLVNGQLNFDPTRLGGGTGVTYRWNFGNGTQTAFSSQPNTTYSYNRPGHYTVTLTVRNAAGQETFYTYNVTVTFPVTATAPTHSSNIVGDANSIYAVNPDSGTVAAIDAQALTKRWETRVGDEPKTLARAPDGRIWVTVQGEDKLVALNPTDGSISATVALPYGSGPYGVAFTPNGSKGLLTLESKSTLIAFDPANGNTSGTLALEGDLRGIAVAADSQTVYVTRFKSKMTGGQLHKVGLSTMGLLSTIALPVDTTTIDTENSARGVANYLSQVVISPDGSRAVLPGKKDNIVRGRFRDGGDLLHDQTVRSILSQVDLSAAMHLLPEQIDFDDRAPARAALFSPAGDYLFVAQMEGNNIAIVDAYTRAVRGEINASSAPHGLYLDATRKRLFVNNFLARSVTVHDVADVLASRSAAAVFLQNVATVAQEPLGAAALRGKLVFYNAADRRMSKDNYMSCASCHADGGDDGMVWDFTQRGEGLRRTISLQGRRGTGHGKLHWSANFDEVQDFENDMRSAFGGTGFLSDADFAATSDPLGAPKAGRNAQLDDLAAYLGSLNKYLRSPARAADGNLTVEAARGQTLFANANCASCHAGGTFQDGLRHDVGTIQPSSGKGANQPLAGVGFDTPTLLGSWAAKSYLHNGQKASVADVLAGGHGNVAGLPAADRQALADYVRSLDTAAEYTTRLRSSHSNLCVNIRGASAASGAVAIQWPCGTANNETFTVRNLAGGYVQLVAKHSNLCLAQDSAATNGAGVVQLACTVGNTAQWTLSGSTLRNRASGACLDVPNNSTAQDIPLLTWTCNGGNNQNWLQQ

SEQ ID NO: 3842 - protein, 1559 aa, unknown
  environmental sample
MKIRYYLLALLLPFATLMTHAAITGVSPMTTLNTMVTTVTRAGEATLALQGPGLGNLTYTSAELFKPVSMITRASGDVPATYPGRKDYGLNVGIMLNGYFLTSFAPDSGLGPGGFLLYDVSNPRAIVLVKKIYEPEGRTKEFREAHSFGTAKIGGKQYVVVPSIKGVEFWDFTDINNIQQVKKLALPTVNGGDYANVAWQLWWQAPYLYVASANDGVYIVDASDPVNAVIANRGAGKPNPVPTGELGGFRVGPIFTMGNHMVLTSMDNTDGFASLDISDPLNPKVLDTVGSNPNYYATCFDGKNLHASARGNGAKMYSYDLSDRTQFVVEDNRLVIDEQLYCGTQDHYVFQGAQFKVHKVDVSNPLNHVEVGQGSLFATNHPDYSHSDHGQVAPMGNLLFIGNDHGSGSGFIVHQTARDTTPPAVKQTSPTNGAKQQALTSRIGVGLTDSILPESVTASTFIVRPVNGNTLAGTYSVQLGIINFHPAQPLAAGTSYEILLTAGGVKDYAGNGIATEYRAVFHTGNATDISLSNHWPLTSALTDEIGANNGTASAADRFEGLGLNFAQRTGGVALKNDSLATALGGTASVAFYMKTTQAGSANPWTAPGIFGRDQANGADDVFWGWLDNTGRVNLSVSNVAANNPGTRSTAPVNDGAWHHVVMTRDAASGAQTVYIDGTKTSSTGLTGTKGLSNKFTLLGQIQGNADFFRGSLADVRVYGRVLSDADVAQLRSQAIIGDVAVSGSPQLVNGQLSFDPTRLGGGTGLTYRWNFGNGTQTNFSAQANASYAYNRPGHYTVTLTVRDAAGRETFYTYNVTVVFPVTATAPTHSSNIVGDANSVYAVNPDSGTVAAIDAVSLAKRWETRVGDEPKTLARAPDGRVWVTVQGEDKLVALNPTDGSISTTITLAYGSGPYGVAFTPNGAKGLLTLESKSTLIAFDPANGNTTGTLALEGDLRGIAVAADSQTAYISRFKSRMTGGQLHKVGLNSMALVSTIALPVDTTTVDTENSSRGVANYLSQVVISPDGGRAVLPGKKDNIVRGRFRDGNDLPHDQTVRSILSQVDLSQGTHLLAEQIDFDDRAPARAALYSPVGDYLFVAQMEGNNIAIVDAYTRAVRGEINASSAPHGLYLDASRKRLFVNNFLARSVTVHDVADVLASRSAAAVFVQNVATVAQEPLAAAALRGKQVFYNAADRRMSKDNYMSCASCHADGGDDGMVWDFTQRGEGLRRTISLQGRRGLGHGKLHWSANFDEVQDFENDMRSAFGGTGFLSDADFAATSDPLGAPKAGRNAQLDDLAAYLTSLNKYMRSPARAADGTLTVEAARGQTLFASANCASCHAGGTLTDGLRHDVGTIQPSSGKGGNQPLAGLGFDTPTLIGSWAAKSYLHNGQKASVLDVMAGGHGNAGSLPAADRQALAEYVRSLDTATDFTTRLRSAHSALCVNIRGASPNSGVVAIQWPCGTAANETFTVRTVAGGFVQLVARHSNLCLAQDSAAASGAGVVQLACSTGNTAQWSLVGSTLRNRASGACLDVPNNSTAQDIPLVTWTCNGGNNQNWTQLP

SEQ ID NO: 3843 - protein, 1559 aa, Acidovorax sp.
MKIRYYLMALLLPFATLLTHAAITGVNPMTTLTTMAAAVTQAAEVPLPLQGPGLGNLTYTSAELFKPVSMITRASGDVPATYPGRKDYGLNVGIMLNGYFLTSFAPDSGLGPGGFLLYDVSNPRAIVLAKKIYEPEGRTKEFREAHAFGTAKIGGKQYVVVPSIKGIEFWDFSDINNIQQVKKLALPTVNGGDYTNVAWQLWWQAPYVYVASANDGVYIVDASDPANAVIANRGAGKPNPVPTGELGGFRVGPIFTMGNHMVLTSMDNTDGFASLDISDPLNPKVLDTVGSNPNYYATCFDGKNLHASARGGGARMYSYDLSDRTQFVVEDNRLVIDEQLYCGMQDHYVFQGAQFKVHKVDVSNPLNHVEVGQGSLFATNDPEYSHSDHGQVAPMGNLLFIGNDHGSGSGFIVHQTARDTTPPAVKQTSPTNGAKQQALTSRIGVGLTDSILPESVHAGTFIVRPVNGNALAGTYSVQLGIINFHPTQPLAAGTSYEIVLTAGGVKDYAGNGIAAEYKAVFHTGNATDISLMNHWPLSSTLTDEIGANNGTASAADQFSSIGLNFAQRTGGVPLKNEGVATALGGTASLAFYMKTTQNGSANAWTAPGLFGRDQSGGADDVFWGWIDNTGRLNLSVGNVAGNNPGTRSTAAVNDGNWHHVVMTRDAASGAQTLYIDGAKTSSTGLTGTKGLSNKFALLGQIQGNADFFRGSLADVRVYGRVLSDADVTQLRSQAIIGDAGVSGGPQLVNGQLSFDPTRLGGGTGVTYRWNFGNGTQTAFSSQANTTYSYNRPGHYTVTLTVRNAAGQDTFYTYNVTVIFPTTATAPTHSSNIVGDANSVYAVNPDSGTVAAIDALALTKRWETRVGDEPKTLARAPDGRIWVTVQGEDKLVALNPADGSIAATVNLPYGSGPYGVTFTPNGSKGLLTLESKSTLVAFDPANGNTTGTLALEGDLRGIAVAADSQTVYVTRFKSKMTGGQLHKVGLSTMGLLSTIALPVDTTTIDTENSSRGVANYLSQVVISPDGSRAVLPGKKDNIVRGRFRDGGDLLHDQTVRSILSQVDLAQATHLLPEQIDFDDRAPARAALFSPAGDYLFVAQMEGNNIAIVDAYTRAVRGEINASSAPHGLYLDTARKRLFVNNFLARSVTVHDVADVLASRSAAAVFLQNVATVAQEPLAAAALRGKLVFYNAADRRMSKDNYMSCASCHADGGDDGMVWDFTQRGEGLRRTISLQGRRGTGHGKLHWSANFDEVQDFENDMRSAFGGTGFLSDADFAATSDPLGTPKAGRNTQLDDLAAYLASLNKYMRSPVRAADGSLTVEAARGQTLFANANCASCHAGGTFQDGLRHDVGSIQASSGKGANQPLAGVGFDTPTLIGSWAARSYLHNGQKASVLDVIAGGHGNVAGLPAADRQALADYVRSLDTASEFTTRLRSSQSTLCVNIRGASAASGAVAIQWPCGTANNETFTVRNLAGGYVQLVAKHSNLCLAQDSAATSGAGVVQLACTVGNTAQWTLSGSTVRNRASGACLDVPNNSTAQDTPLLTWTCNGGNNQNWNQLP

SEQ ID NO: 3844 - protein, 1559 aa, unknown
  environmental sample
MKIRYYLMALLLPFATLLTHAAITGVNPMTTLTTMAAAVTQAAEVPLPLQGPGLGNLTYTSAELFKPVSMITRASGDVPSTSPGRKDYGLNVGIMLNGYFLTSFAPDSGLGPGGFLLYDLSNPRAIVLVKKIYEPEGRTKEFREAHAFGTAKINGRQYVVVPSIKGIEFWDFTDINNIQQVKKLVLPTVNGGDYANVAWQLWWQAPYVYVASANDGVYIVDASDPANAVIANRGAGKPNPVPTGELGGFRVGPIFTMGNHMVLTSMDNTDGFASLDISDPLNPKVLDNVGSNPNYYATCFDGRNLHASARGGGAKMYSYDLSDRTQFLVEDNRLVIDEQLYCGMQDHYVFQGAQFKVHKVDVSNPLNHVEVGQGSLFATNDPEYSHSDHGQVAPMGNLLFIGNDHGSGSGFIVHQTTRDTTPPAVKQTSPTQGAKQQALTSRIGVGLTDSILPESVNASTFIVRPVNGNTLQGTYSVQLGIINFHPAQPLAAGTTYEILLPAGGVKDYAGNAIASQYRSVFHTGNATDISLMNHWPLTSGLADEISANNGTASAADQFGSIGLNFAQRTGGVPLKNDGVATALGGTASLAFYMKTTQNGSANAWTAPGIFGRDQSGGADDVFWGWIDNTGRMNLSVGNAAGNNPGTRSTAAVNDGNWHHVVMTRDAASGAQTLYIDGAKTSSTGLTGTKGLSNKFALLGQIQGNADFFRGSLADVRIYGRVLNDADVAQLRSQAIIGDAGVSGGPQLVNGQMNFAPTRLGGGTGVTYRWNFGNGTQTAFSSQANTTYSYNRPGHYTVTLTVRDAAGLETFYTYNVTVTFPTTATAPTHSSNIVGDANSIYTVNPDSGTVAAIDATALTKRWETRVGDEPKTLARGPDGRLWVTVQGEDKLVALNPTDGSISATIALAYGSGPYGVAFTPNGSKGLLSLESKSTLLTFDPANGSITGTLALEGDLRGIAVAADSQTAYITRFKSTMTGGQLHKVNLNGMQLLSTIALPVDTTTVDTENSARGVANYLSQVVISPDGSRAVLPGKKDNIVRGRFRDGNDLLHDQTVRSILSQVDLTQATHLLPEQIDFDDRAPARAALFSPAGDYLFVAQMEGKNIAIVDAYTRAVRGEIKASSAPHGLYLDATRKRLFVNNFLARSVTVHDVADVLASRSAAAVFLQNIATVAQEPMAAAALRGKLVFYNAADRRMSKDNYMSCASCHADGGDDGMVWDFTQRGEGLRRTISLQGRRGTGHGKLHWSANFDEAQDFENDMRSAFGGTGFLSDADFAATSDPLGAPKAGRNPQLDDLAAYLASLNKYLRSPARAADGNLTVEAARGQTLFANANCASCHAGGTFQDGLRHDVGSIQPSSGKGANQPLAGVGFDTPTLLGSWTAKSYLHNGQKASVLDVITDGHGNAAGLPAADQQALAAYVRSLDATAEYTTRLRSNHSNLCVNIRGASANAGAVAIQWPCGTANNETFTVRSGAGGYVQLVARHSNLCLAQDSAAASGASVVQLACSAGNTAQWSLVSSTLRNRASGACLDVPNNATAQDTPLLTWTCNGGNNQNWVQLP

SEQ ID NO: 3845 - protein, 1579 aa, unknown
  environmental sample
MKLRKILGVGLLSSCVWLAHAAITGTSPYQNLKSAANAVAALVADPLPLQGPGLGNLSYTQAELFKPLSMIKEEVVPGGDGLGADVPKIPGGSVTHPTAGYTKYHFGLNVGLMINGYFLTAFSPDGGLGPGGFLMYDISNPRQIKLVKKIFEPDGRTKEFREPHAIGAAKINGKQYVVIPSTRGIEFWDFTDINDIQQVKKLAFPTVDRGDYANVSWQLWWQAPYVYVASSNDGMYIVDARDPANAVLANRGAGKPNPVPTGELGGFRLGPIFTLGNHMVLTSMDNTAGFSSLDISDPLNPKVLDTVLSNPNYYATCFDGRELHASARGTGAKMYSYDLDDPSRFVAQDKRLQIDEQLYCGTQDNFVFQGAQRKIHKVDVSNPLNHVEVGRGGIFPPGSTDEANSDHGQVAPFGNLVFVGNDHGSGSAFMVHAMDPDTTRPEVKQVSPRSGAKQQALSTRVGVGMTDSILPETVNASTFIVRPVGGNSLAGTYSLQLGILNFFPDQPLQPNTTYEVFLPAGGVKDYAGNSLGADYRSTFTTGSSTDINLVHHWTLAGTLGDSIGNNNGTPAGGDAYDPIGLNFAQRSGGVPLQSDGVASVLGGTASLSFYMKTTQTGSANPWDAPGIFGRDQSPGGSDVFWGWLDASGYINLSVGNKSASNPGTRSTAAVNDGNWHHVVLTRDAASGAQTLYVDGVKTGSTGATGTLGLNNKFQVMGQIQGAAAFFKGTLAEVRVYNRVLGDADVALLRERAVVGDPGLGSGPKIVNGQIAFGPSVLGGGGATYSWNLGDGTRTPFSAQAGYTHTYAQPGHYTVTLTVRDANGRESYYTYNVTVITPITTASPSHSSNIVGDAGSVYSVNPDSGTVAAVDAQTLAKRWEVSVGTEPKTLAVGPDGRIWVTVQGDDKLVALNAADGSLSATVALDYGSGPYGVAFTPDRTTGLLTLESKSALASFDPASGAITGRVALQGDVRGISVAANSQTAYVTRFRSTATGGQLHKVALQPLALTGTIALSVDTTTADDESKARGVPNYLSQVVVSPDGARAMLPSKKDNIVRGLFRDGQRMEHDRTVRSILSQVNLAQATEVFSEQLDFDDRAPARAALYSPWGDFIFVAQMEGNRVAIVDSYTRAIRGEIADVGSAPHGLYLDTARNRLFVNNFLGRSVAVYDVGAVLSAQTNAAKPLGSVATVAQEPLAAAVLRGKLLFYNAADRRMSKDNYMSCASCHADGGDDGMVWDFTQRGEGLRRTISLQGRQGLGHGKLHWSANFDEVQDFENDIRAEFGGIGFMSNVDYSATADPLGPPKAGKSAQLDDLAAYLASLNKYMRSPARNADGSLSVDAARGQTVFASAQCATCHSGATFQDGQRHDVNTIQPSSGKGMNQPLAGVGFDTPTLTGTWKNASFFHNGQAATMQDVLAGGHGNAASLPAADVVALREYVRSLDTGVAAAQVVRIRSSLSSQCVNIRGAATTSGAAAVQWPCGSAEHEKFTVNDVGGGYVQFVAKHSGLCLAQNGSGASNVPVVQLACSVGATAQWSLSGATIRNRASGACLDVPGSSTAQDTQLIAWTCGGTNNQNWSQIP

SEQ ID NO: 3846 - protein, 68 aa, Actinomyces Sp.
MDKFTRRTTTLSDSDFSQAVSSETQAPIEGAEGFSCPGAEYACNNRCRSIGYRGGYCGSWLNLQCRCY

SEQ ID NO: 3847 - protein, 354 aa, Arthrobacter sp.
MKKSLATFRTLAVSGVLALAVVAGPAPLANAVGEGPNYDGNGQITTSKLATYDQMVSFLKDQDARQSAMELEVIGQTVKGRDIHLVKYISDPAKPTILYLTQQHGNEQLTTEGALEFVKHLGTGKSADILDGVNILIVPMLNADGAMGDVNFPLDDYLAKGDRNMTRYNAEEVDLNRDHVAKIQPETQALHNNVMRKYNIDYMIDLHHQGTRSERDGELVSGSILYPTTPNANPAVVEKSKQLGAVVFHNVDSTGWGHLGKYVGGSAETISRNGIAVEYGIATLLFEMRGMSDHYLDGYALGLRSNGYLIKQTVTTLAATAAAIADGSIAGADTSFWDSLATQTSRPGGEADDE

SEQ ID NO: 3848 - protein, 354 aa, Arthrobacter sp.
MKKSLATFRTLAVSGVLALAVVAGPAPLANAVGEGPNYDGNGQITTSKLATYDQMASFLKDQDARQSAMELEVIGQTVKGRDIHLVKYISDPAKPTILYLTQQHGNEQLTTEGALEFVKHLGTGKSADILGGVNILIVPMLNADGAMGDVNFPLDDYLAKGDRNMTRYNAEEVDLNRDHVAKVQPETQALHNNVMRKYSIDYMIDLHHQGTRSERDGELVSGSILYPTTPNANPAVVEKSKQLGAVVFHNVDSTGWGHLGKYVGGSAETISRNGIAVEYGIATLLFEMRGMSDHYADGVALGLRSNGYLIQQTVTTLTSTAAAIADGSIADADISFWDSLATQTSRPGEEADGE

SEQ ID NO: 3849 - protein, 353 aa, Arthrobacter sp.
MRKTLATFRTLAVTGALALAVVAAPAPAMAVGEGPNYDGNGQITTSKLATYDQMVSFLKDQDARQSAMELEVIGQTVKGRDIHLVKYISDPAKPTILYLTQQHGNEQLTTEGALEFVKHLGTGKSADILDGVNILIVPMLNADGAMGDVNFSLEDYIAKGDRNMTRYNANEVDLNRDHVAKIQPETQALHDNVMRKYNIDYMIDLHHQGTRSQRDGELVSGSILYPTTPNADPAVVEKSKQLGAVVFENVDSTGWGHLGKYVGGSAETISRNGIAVEYGISTLLFEMRGMSDHYLDGYALGLRSNGYLIKQTVTTLTATAAAIADGSIADADTSFWDSLATQTSRPGEEADDE

SEQ ID NO: 3850 - protein, 353 aa, unknown
  environmental sample
MRKTLATFRTLALTGALALAAVTVPAPALAVGEGPNYDGNGQITTSKLATYDQMVAFLKDQDARQPAMELEVIGQTVKGRDIHLVKYISDPANPTILYLTQQHGNEQLTTEGALEFVKHLGTGKSGDILDGVNILVVPMLNADGAMGDVNFSLDDYLAKGDRNMTRYNAEEVDLNRDHVAKVQPETQALHNNVMRKYQVDYMIDLHHQGTRSERDGKLVSGSILYPTTPNADPAVVQKSKQLGAVVFDNVDSTGWGHLGKYVGGSAETISRNGIAVEYGIATLLFEMRGMSDHYLDGYALGLRSNGYLIKQTVTTLTATAAAIADGSIADADTSFWDSLATQTSRPGEEADDE

SEQ ID NO: 3851 - protein, 351 aa, unknown
  environmental sample
MKKSLRTLAVSGALALAVVAGPAPLAQAVGEGPNYDGNGQVTTSKLATYDQMVSFLKDQDAKQQAMELEVIGQTVKGRDIHLVKYISDEDNPSILYLTQQHGNEQLTTEGALEFVKHLGTGKSGDILAGVNILIVPMLNADGAMGDVNFPLDDYVAKGDRNLTRYNAEGVDLNRDHVAKVQPETQALHNNVMRKYDIDYMIDLHHQGTRSERDGELVSGSILYPTTPNADPAVVERSKQLGAVVFDNVDSTGWGHLGKYQGGSAETISRNGIAVEYGISTLLFEMRGMSDHYLDGYALGLRSNGYLIKQTVTTLTSTAAAIADGSIADADTSFWDSLAEQTSRPGGEADDE

SEQ ID NO: 3852 - protein, 351 aa, Arthrobacter sp.
MTKSLRTLAVSGALALAVAAGPAPLAGAVGEGPSYDGNGQITTSKLATYDQMVSFLKDQDARQPAMELEVIGQTVKGRDIHLVKYISDPAKPTILYLTQQHGNEQLTTEGALEFVKHLGTGKSAGILDGVNILIVPMLNGDGAMGDVNFSLDDYLARGDRHLTRYNAEGVDLNRDHVAKVQPETQALHNNVMRKYRIDYMIDLHHQGTRAERDGKLVSGSILYPTTPNADPAVVEKSKRLGAVVFNNVDSTGWGHLGRYQGGSAETISRNGISVEYGIATLLFEMRGMSDHYLDGYALGQRSNGYLIKQTVTTLASTAAAIADGSIADADTSFWDTLAEQTSRPAGEAEDE

SEQ ID NO: 3853 - protein, 351 aa, Arthrobacter sp.
MTKSFRILAVTGALALAVVAGPAPLANAVGEGPTYDGNGQITTSKLATYDQLVSFLKDQDARQPAMELEVIGQTVKGRDIHLVKYISDPAKPTILYLTQQHGNEQLTTEGAMEFIKHLGTGKSAGILDGVNILIVPMLNADGAMGDVNFSLEDYLAKGDRHLTRYNAEGVDLNRDHVAKIQPETQALHNNVMRKYRIDYMIDLHHQGTRAERDGKLVSGSILYPTTPNADPAVVEKSKQLGAVVFNNVDSTGWGHLGKYQGGSAETISRNGLSVEYGIATLLFEMRGMSDHYVDGYALGQRSNGYLIQQTVTTLTSTAAAIADGSIADADTSFWDTLAEQTSRPAGEAEDE

SEQ ID NO: 3854 - protein, 342 aa, unknown
  environmental sample
MSGALALAVVAGPAPLAQAVGEGPNYDGNGQVTTSKLATYDQMVSFLKDQDAKQQAMELEVIGQTVKGRDIHLVKYISDEDNPSILYLTQQHGNEQLTTEGALEFVKHLGTGKSGDILAGVNILIVPMLNADGAMGDVNFPLDDYVAKGDRNLTRYNAEGVDLNRDHVAKVQPETQALHNNVMRKYDIDYMIDLHHQGTRSERDGELVSGSILYPTTPNADPAVVERSKQLGAVVFDNVDSTGWGHLGKYQGGSAETISRNGIAVEYGISTLLFEMRGMSDHYLDGYALGLRSNGYLIKQTVTTLTSTAAAIADGSIADADTSFWDSLAEQTSRPGGEADDE

SEQ ID NO: 3855 - protein, 359 aa, Arthrobacter sp.
MHSKEVTRCEEILEDLAVSGALALAVVAGPAPLAQAVGEGPNYDGNGQVTTSKLATYDQMVSFLKDQDAKQQAMELEVIGQTVKGRDLHLVKYISDPDNPTILYLTQQHGNEQLTTEGALEFVKHLGTGKSGDILSGVNILIVPMLNADGAMGDVNFPLDDYVAKGDRNLTRYNAEGVDLNRDHVAKVQPETQALHNNVMRKYDIDYMIDLHHQGTRSERDGELVSGSILYPTTPNADPAVVERSKQLGAVVFDNVDSTGWGHLGKYQGGSAETISRNGIAVEYGISTLLFEMRGMSDHYLDGYALGLRSNGYLIKQTVTTLTSTAAAIADGSIADADTSFWDGLAEQTSRPGGEADDE

SEQ ID NO: 3856 - protein, 361 aa, Arthrobacter sp.
MHSKEVTHVKKSLATFRTLAATGALALAVVAAPAPAIAVGEGPNYGGNGQITTSKLATYDQMVSFLKDQDAKQPAMELEVIGKTVKGRDIHLVKYISDPAKPTILYLTQQHGNEQLTTEGALEFVKHLGTEKSADILKGVNILVVPMLNADGAMGDVDFSLEDYIAKGDRNMTRFNAKGVDLNRDHVAKIQPETQALHNNVMGKYRVDYMIDLHHQGTRAERDGKLVSGSILYPTTPNADPAVVERSKQLGAVVFDNVDSTGWGHLGKYQGGSAETISRNGISVEYGIATLLFEMRGMSDHYLDGYALGQRSNGYLIKQTVTTLTSTAAAIADGSIADADTSFWDTLAEQTSRPAGEADDE

SEQ ID NO: 3857 - protein, 361 aa, Arthrobacter sp.
MHSKEVPHVKKSLAAFKALTAAGALSLAVVAAPAPALAVGEGPNYGGNGQITTSKLATYSQMVSFLKDQDAKQPAMELEVIGQTVKGRDIHLVKYISDPAKPTILYLTQQHGNEQLTTEGAMEFIKHLGTGKSSGILDGVNILIVPMLNADGAMGDVNFSLDDYLAKGDRHLTRYNAEGVDLNRDHVAKVQPETQALHSNVMRKYRVDYMIDLHHQGTRAERDGKLVSGSILYPTTPNADPAVVEKSKRLGAVVFNNVDSTGWGHLGKYQGGSAETISRNGISVEYGIATLLFEMRGMSDHYLDGYALGQRSNGYLIKQTVTTLTSTAAAIADGSIADADTSFWDTLAEQTSRPAGEAEDE

SEQ ID NO: 3858 - protein, 342 aa, Arthrobacter sp.
MKKTLAAAALAGALTISSVAGPAVAVGEGPHYNGNETINTSILRTYDELASYLKTQDAKQEAMELEVIGQSVKGRDLHLAKYISNPDNPTILFLTQQHGNEQLTTEGALEFIKHLGTGKTGDVLDGVNVLIVPMLNPDGAMGDVDFPLDDYIASGDRHLTRYNALGVDLNRDHVDKIQPETQALHTNVMEKYRIDYMIDLHHQGTSSERDGELVSGSILHPTTPNVDPAVLEGSKRLGAVVFGAVDSTGWGHLGKYNGGSAETISRNGIAVEYGISTLLFEMRGMSDHFNEGAVLGQKSNGYLIKQTITTLDTSVRAIADGSINTADTSFWDTLSTQNTRAE

SEQ ID NO: 3859 - protein, 342 aa, Arthrobacter sp.
MKKTLAAAVLAGALTISSVAGPAVAVGEGPNYNGNETINTSILRTYDELASYLKTQDAKQETMELEVIGQSVKGRDLYLAKYMSNPDNPTILFLTQQHGNEQLTTEGALEFIKHLGTGKTGDVLAGVNVLIVPMLNPDGAMGDVDFPLDDYIASGDRHLTRYNALGVDLNRDHVSKIQPETRALHTNVMAKYGIDYMIDLHHQGTSSERDGELVSGSILHPTTPNVDPAVLEGSKRLGAVVFGAVDSTGWGHLGKYNGGSAETISRNGIAVEYGISTLLFEMRGMSDHFNDGAVLGQKSNGYLIKQTITTLDASVRAIADGSINSADTSFWDTLATQNTRAE

SEQ ID NO: 3860 - protein, 346 aa, Sporosarcina sp.
MKKTVLNLSIAGAMMLSVSSFGSPIANAVGNGPTYGGNETINTSILHTYDEMVDYLKKEEAKQQDMELEVIGQSIKGRDLYLAKYMKNPENPTILFLTQQHGNEQLTTEGALEFIKHLGTNKMKDVTDEVNILIVPMLNADGAMGDVDFSLDDYIAKGDRNLTRYNAAEVDLNRDHVTKIQPETKALHNNVMKKYNIDYMIDLHHQGAMSERDGKLVSGSILYPTTPNADPEVVEKSKQLGAVVFDAIDEKGWGHLGKYNGGSAETISRNGIAVEYGISTLLFEMRGMSDHEYESYVLGQKSNGYLIKQTITTLEATVNAIADGSIETKDTSFWDSLAYQTTRPSE

SEQ ID NO: 3861 - protein, 346 aa, Bhargavaea sp.
MKKTMISLVAAGALVLSAAPLQADAVGNGPNYGGNETINTSILHTYSEMASYLQKQEAKQKDMELEVIGQSVKGRDLYLVKYMKNPENPTILFLTQQHGNEQLTTEGALEFIKHLGTGKMKGVTDNVNILIVPMLNPDGAMGDVDFSLDDYVASGDRHLTRYNALGVDLNRDHVTKIQPETQALHNQVMQKYDIDYMIDLHHQGARSERDGELVSGSILYPTTPNVDPDVLEGSKKLGAVVFDAVDSTGWGHLGKYVGGTAETISRNGIAVEYGISTLLFEMRGMSDHEYEPYVLGQKSNGYLIKQTITTLDATVRAIADGSIESKDTSFWDTLAEQRTRQSEEDE

SEQ ID NO: 3862 - protein, 345 aa, Arthrobacter sp.
MKKQLAAAAMAGALAFTSVAVAAPAALAVGEGPGYGGKETINTSILRTYDELADFLKTQDAKQPQMELEVIGQSVKGRDLFLAKYIQNPENPTILFLTQQHGNEQLTTEGALEFIKHLGTGKTGDVLDNANVLIVPMLNPDGAMGDVDFSLDNYIASGDRHLTRFNALGVDLNRDHVAKIQPETQALHSNVMAKYDIDYMIDLHHQGANSERDGQLVSGSILHPTTPNVDPAVLEGSKKLGAVVFDAVDSTGWGHLGKYSGGDAETISRNGIAVEYGISTLLFEMRGMSDHFNEGSVLGQKSNGYLIKQTITTLDATVNAIADGSIDTADTSFWDTLATQNTRSE

SEQ ID NO: 3863 - protein, 347 aa, Arthrobacter sp.
MVKAPRKFAALSLAVLLTTGATAAAPAFAVGEGPNYGGNETINTSILRSYDEVVAELKEQDARQSALELEVIGQSVKGRDLYLAKYITNPDNPTILYLTQQHGNEQLTTEGALEFIKHLGTGKSGGVLDGVNILVVPMLNPDGAMGDVDFALDGYIADGGRTLTRANANNVDLNRDHVNKLEPETQALHDNVMRAYNIDYMIDLHHQGTQSERDGDLVSGSILYPTTPNVDPAVLDGSKRLGSVVFDAVDSTGWGHLGRYVGGDAETISRNGIAVEYGISTLLFEMRGMSDNTRDSAVLGQKSNGYLIKQTVVTLDATAQAIADGSIVTADTSFWDTLAEQTTRTSE

SEQ ID NO: 3864 - protein, 347 aa, Sporosarcina sp.
MKKTMLAFSLAGALVLSASPFALPIAEAVGNGPNYGGNETINTSILHTYDEMVDNLKKQQTKQKDMELEVIGQSVKGRDLYLVKYIKNPENPTILFLTQQHGNEQLTTEGSLEFIKHLGTGKMKGVIDGVNILIVPMLNADGAMGDVDFSLDDYIASGSRHLTRYNALGVDLNRDHVNKIQPETKALHDNVIRAYNVDYMIDLHHQGTKSERDGELVSGSILYPTTPNVSPDVLLKSKQLGAVVFDSVDSTGWGHLGKYNGGSAETISRNGIAVEYGISTLLFEMRGMSDHSSESAVLGQKSNGYLIKQTIKTLDATVRAIADRSIDNKDISFWDTLATQQSQPSKE

SEQ ID NO: 3865 - protein, 362 aa, Planomicrobium sp.
MANRFTEQRVEKQNRTKRKLMAFSVAGALMLSAAPFTAPVAEAVGNGPGYGGNETINTSILHTYDEMVSYLKTQEAKQKNMELEVIGQSVKGRDLYLVKYMTNPENPTILFLTQQHGNEQLTTEGALEFIKHLGTGKMKGVTDGVNILIVPMLNADGAMGDVDFSLEDYVASGDRNLTRYNAREVDLNRDHVNKIQPETQALHNNVMRKYDIDYMIDLHHQGTQSERDGQLVSGSILYPTTPNVDPDVLLKSKQLGAVVFNAVDSTGWGHIGKYSGGTAETISRNGIAVEYGISTLLFEMRGMSDHEYEPYVLGQKSNGYLIKQTITTLDAAVRAIADGSIADADVSFWDTLATQTNRPSEE

SEQ ID NO: 3866 - protein, 274 aa, Bacillus sp.
MKKQLVTATTAVVLGTTLFAGAASAQTIKVKKGDTLWGLSNRYGTSINSIKSENKLKSDIIYIGQTLSINGKSSSGSNSGSKSSSSTYKVVKGDSLWKIANKYKMTVNQLKSLNGLKTDLIRIGQVLKVKGSTSGSTSSGSSSSKQPSSSHNAAQTSLNVNKLISDAQSLIGTPYVWGGTTTSGFDCSGFIWYLLNKQTSVGRTSTAGYWSSMKSVSSPSRGDFVFFTTYQAGPSHMGVYIGNNKFIHAGSDGVTTSDLNNSYWKPRYLGAKRF

SEQ ID NO: 3867 - protein, 274 aa, Bacillus sp.
MKKQLVTATTAVVLGTTLFAGAASAQTIKVKKGDTLWGLSNRYGTSINSIKSENKLKSDIIYIGQTLSINGKSSSGSSSSSKSSSSTYKVVKGDSLWKIANKYKMTVNQLKSLNGLKTDLIRIGQVLKVKGSTSGSTSSGSSSSKQPSSSHNAAQTSLNVNKLISDAQSLIGTPYVWGGTTTSGFDCSGFIWYLLNKQTSVGRTSTAGYWSSMKSVSSPSRGDFVFFTTYQAGPSHMGVYIGNNKFIHAGSDGVTTSDLNNSYWKPRYLGAKRF

SEQ ID NO: 3868 - protein, 274 aa, Bacillus sp.
MKKQLVTATTAVVLGTTLFAGAASAQTIKVKKGDTLWGLSNRYGTSINSIKSENKLKSDIIYIGQTLSINGKSSSGSSSSSKSSSSTYKVVKGDSLWKIANKYKMTVNQLKSLNGLKTDLIRIGQVLKVKGSTSGSTSSGSSSSKQPSSSHNVAQTSLNVNKLISDAQSLTGTPYVWGGTTTSGFDCSGFIWYLLNKQTSVGRTSTAGYWSSMKSVSSPSRGDFVFFTTYQAGPSHMGVYIGNNKFIHAGSDGVTTSDLNNSYWKPRYLGAKRF

SEQ ID NO: 3869 - protein, 276 aa, Bacillus sp.
MKKQLVTATTAVVLGTTLFAGAASAQTIKVKKGDTLWGLSNQYGTSINSIKSENKLKSDIIYIGQTLSINGKSSSGSSSGSKSSSSTYKVVKGDSLWKIANKYKMSVNQLKSLNGLKTDLIRIGQVLKVKGSTSGSNSGTSTGSSSNQSSSNHNAAQTSLNVNKLVSDAQSLIGTPYVWGGTTTSGFDCSGFIWYLLNKQTSVGRTSTAGYWSSMKSVSSPSKGDFVFFTTYQAGPSHMGVYIGNNKFIHAGSDGVTTSDLNNSYWKPRYLGAKRF

SEQ ID NO: 3870 - protein, 276 aa, Bacillus sp.
MKKQLVTATTAVVLGTTLFAGAASAQTIKVKKGDTLWGLSNQYGTSINSIKSENKLKSDIIYIGQTLSINGKSSSGSSSGSNSSSSTYKVVKGDSLWKIANKYKMSVNQLKSLNGLKTDLIRIGQVLKVKGSTSGSNSGTSTGSSSNQSSSNHNAAQTSLNVNKLVSDAQSLIGTPYVWGGTTTSGFDCSGFIWYLLNKQTSVGRTSTAGYWSSMKSVSSPSKGDFVFFTTYQAGPSHMGVYIGNNKFIHAGSDGVTTSDLNNSYWKPRYLGAKRF

SEQ ID NO: 3871 - protein, 276 aa, Bacillus sp.
MKKQLVTATTAVVLGTTLFAGAASAQTIKVKKGDTLWGLSNQYGTSINSIKSENKLKSDIIYIGQTLSINGKSSSGSSSGSNSSSSTYKVVKGDSLWKIANKYKMSVNQLKSLNGLKTDLIRIGQVLKVKGSTSGSNSGTSTGSSSNQSSSNYNAAQTSLNVNKLVSDAQSLIGTPYVWGGTTTSGFDCSGFIWYLLNKQTSVGRTSTAGYWSSMKSVSSPSKGDFVFFTTYQAGPSHMGVYIGNNKFIHAGSDGVTTSDLNNSYWKPRYLGAKRF

SEQ ID NO: 3872 - protein, 276 aa, Bacillus sp.
MKKQLVTATTAVVLGTTLFAGAASAQTIKVKKGDTLWGLSNQYGTSINSIKSENKLKSDIIYIGQTLSINGKSSSGSSSGSNSSSSTYKVVKGDSLWKIANKYKMSVNQLKSLNGLKTDLICIGQVLKVKGSTSGSNSGTSTGSSSNQSSSNYNAAQTSLNVNKLVSDAQSLIGTPYVWGGTTTSGFDCSGFIWYLLNKQTSVGRTSTAGYWSSMKSVSSPSKGDFVFFTTYQAGPSHMGVYIGNNKFIHAGSDGVTTSDLNNSYWKPRYLGAKRF

SEQ ID NO: 3873 - protein, 277 aa, Bacillus sp.
MKKQIITATTAVVLGSTLFAGAASAQSVKVKKGDTLWGLSKKYGTSINSIKSENKLKSDIIYIGQTLSVNGKSSSTSSSSSSSSSSTYKVVSGDSLWKISKKYSMTINELKKLNGLKTDLIRVGQVLKVKGSSSSSNQSSSNVSASKPSTSSGSNVSSTSLNVSKLVSDAKALTGTPYKWGGTTTSGFDCSGFIWYLLNKQTNVGRTSTAGYWSSMKSVSSPSVGDFVFFTTYQAGPSHMGVYIGNNKFIHAGSDGVQTSDLNNSYWKPRYLGAKRF

SEQ ID NO: 3874 - protein, 278 aa, Bacillus sp.
MKKQIITATTAVVLGSTLFAGAASAQSVKVKKGDTLWGLSKKYGTSINSIKSENKLKSDIIYIGQTLSVNGKSSSTSSSSSSSSSSSTYKVVSGDSLWKISKKYSMTINELKKLNGLKTDLIRVGQVLKVKGSSSSSNQSSSNVSASKPSTSSGSNVSSTSLNVSKLVSDAKALTGTPYKWGGTTTSGFDCSGFIWYLLNKQTNVGRTSTAGYWSSMKSVSSPSVGDFVFFTTYQAGPSHMGVYIGNNKFIHAGSDGVQTSDLNNSYWKPRYLGAKRF

SEQ ID NO: 3875 - protein, 275 aa, Bacillus sp.
MKKQVITAASAVVLGSTLFAGAASAQTITVKKGDTLWGFSKKYGTSISKIKQENKLKSDIIYIGQRLSINGSSSSSAKASQASSATHKVVKGDSLWKISRTYGMTVNELKSLNGLKTDLIRIGQVLKVKGTKSVKAASTTKPSSSSKTSKAPAQTSSALNTSKLVSDAKALIGTPYKWGGTSTSGFDCSGFVWYILNKQTNVARTNTAGYWNSMKSVSSPAVGDFVFFTTYQPGPSHMGVYIGNNQFVHAGSDGVTISDMTNSYWKPRYLGAKRF

SEQ ID NO: 3876 - protein, 275 aa, Bacillus sp.
MKKQVITVASAVVLGSTLFAGAASAQTITVKKGDTLWGFSKKYGTSISKIKQENKLKSDIIYIGQRLSINGSSSSSAKASQASSATHKVVKGDSLWKISRTYGMTVNELKSLNGLKTDLIRIGQVLKVKGTKSVKAASTTKPSSSSKTSKAPAQTSSALNTSKLVSDAKALIGTPYKWGGTSTSGFDCSGFVWYILNKQTNVARTNTAGYWNSMKSVSSPAVGDFVFFTTYQPGPSHMGVYIGNNQFVHAGSDGVTISDMTNSYWKPRYLGAKRF

SEQ ID NO: 3877 - protein, 274 aa, Bacillus sp.
MKKQVLTATTAIVLGTSLFAGAASAQTVKVKKGDTLWGFSKKYGTTINKIKKENKLTSDTIYIGQTLSINGSSKQSKASKSAASSSSTHKVVRGDSLWKISKTYNMTVNELKKLNGLKTDLIRIGQVLKVKGTSSVKAASTTKPSSTSKKTTQSSTKLNTSKLVSDARALIGTPYKWGGTTPSGFDCSGFIWYLLNKQTNVARTSTAGYWSSMTKVSSPAVGDFVFFTTYKAGPSHMGVYIGNNKFIHASSDGVMTSDMTSSYWKPRYLGAKRF

SEQ ID NO: 3878 - protein, 275 aa, Bacillus sp.
MKKQVITAASAVVLGSTLFAGAASAQTITVKKGDTLWGFSKKYGTSVSKIKQENKLKSDIIYIGQRLSINGSSSSSAKASQASSATHKVVKGDSLWKISRTYGMTVNELKSLNGLKTDLIRIGQVLKVKGTKSVKAASTTKPSASSGTSKAPAQTSSALNTSKLVSDAKALIGTPYKWGGTSASGFDCSGFVWYILNKQTNVARTNTAGYWNSMKSVSSPAVGDFVFFTTYQPGPSHMGVYIGNNQFVHAGSDGVTISDMTNSYWKPRYLGAKRF

SEQ ID NO: 3879 - protein, 274 aa, Bacillus sp.
MKKQVLTATTAIVLGTSLFAGAASAQTVKVKKGDTLWGFSKKYGTTINKIKKENKLTSDTIYIGQTLSINGSSKQSKASKSAASSSSTHKVVRGDSLWKISKTYNMTVNELKKLNGLKTDLIRIGQVLKVKGTSNVKAASTTKPSSTSKKTTQSSTKLNTSKLVSDARALIGTPYKWGGTTPSGFDCSGFIWYLLNKQTNVARTSTAGYWSSMTKVSSPAVGDFVFFTTYKAGPSHMGVYIGNNKFIHASSDGVMTSDMTSSYWKPRYLGAKRF

SEQ ID NO: 3880 - protein, 278 aa, Bacillus sp.
MKKQVITAASAVVLGSTLFAGAASAQTITVKKGDTLWGFSKKYGTSVSKIKQENKLNSDIIYIGQRLSINGSSSSSAKASQASSATHKVVKGDSLWKISRTYGMTVNELKSLNGLKTDLIRIGQVLKVKGTKSVKAASTTKPSASSGTSKTSKAPAQTSSALNTSKLVSDAKALIGTPYKWGGTSTSGFDCSGFVWYILNKQTNVARTNTVGYWNSMKSVSSPAVGDFVFFTTYQPGPSHMGVYIGNNQFVHAGSDGVTISDMTNSYWKPRYLGAKRF

SEQ ID NO: 3881 - protein, 277 aa, Bacillus sp.
MKKQVITAASAVVLGSTLFAGAASAQTITVKKGDTLWGFSKKYGTTVSKIKQENKLKSDIIYIGQRLSINGSSSSSAKASKVSSATHKVVKGDSLWKISRTYGMTVNELKTLNGLKTDLIRIGQVLKVKGTKSVKAASTTKPSASSGTSKTSAPAQKSSTLNTSKLVSDAKALIGTPYKWGGTSTSGFDCSGFVWYILNKQTNVARTNTVGYWNSMKSVSSPAVGDFVFFTTYQPGPSHMGVYIGNNQFVHAGSDGVTISDMTNSYWKPRYLGAKRF

SEQ ID NO: 3882 - protein, 277 aa, Bacillus sp.
MKKQVITAASAVVLGSTLFAGAASAQTITVKKGDTLWGFSKKYGTTVSKIKQENKLKSDIIYIGQRLSINGSSSSSAKASKVSSATHKVVKGDSLWKISRTYGMTVNELKTLNGLKTDLIRIGQVLKVKGTKSVKAASTTKPSASSGTSKTSAPAQKSSTLNTSKLVSDAKALIGTPYKWGGTSTSGFDCSGFVWYILNKQTNVARTNTVGYWNSMKSVSSPAVGDFVFFTTYQPGPSHMGVYIGNNQFVHAGSDGVTISNMTNSYWKPRYLGAKRF

SEQ ID NO: 3883 - protein, 271 aa, Bacillus sp.
MKKQVLTAASAIVLGTTLFAGAASAQTVKVKKGDTLWGFSKKYGTTVSKIKKENKLNSDIIYIGQTLSINGSSKTSSSTNTSSSTYKVVRGDTLWKISRSYNMTVNELKNLNGLKTDLIRIGQVLKVKGNAKAASSNTAVKSSQTSKSQTSSSKLNTSKLVSDAQALIGTPYKWGGTSPSGFDCSGFVWYLLNKQTNVARTNTVGYWNSMTSISSPAVGDFVFFTTYQPGPSHMGVYIGNNKFIHAGSDGVTTSDMTSSYWKPRYLGAKRF

SEQ ID NO: 3884 - protein, 128 aa, Burkholderia Sp.
MPSLASLARLRPGTLRAAGLALMPLLIALPLAAQAASFDCKQARQADERAICASRALSEQDVEMSVRYEMLMGLVAMGTRGDMGEAQQQWLKRRARCGASQSCLATAYRERIDALKQQYRQLQSRGPF

SEQ ID NO: 3885 - protein, 128 aa, Burkholderia Sp.
MPYPSCLARLRPGTLRAAGLALLPLLIALPLAAQAASFDCKQARQADERAICASRALSEQDVEMSVRYEMLMGLVAMGTRGDMGEAQQQWLKRRARCGASQSCLATAYRERIDALKQQYRQLQSRGPF

SEQ ID NO: 3886 - protein, 128 aa, Burkholderia Sp.
MPYLSCLARLRPGTLRAAGLALMPLLIALPLAAQAASFDCKQARQADERAICASRALSEQDVEMSVRYEMLMGLVAMGTRGDMGEAQQQWLKRRARCGASQSCLATAYRERIDALKQQYRQLQSRGPF

SEQ ID NO: 3887 - protein, 114 aa, Burkholderia Sp.
MRAAGLALLPLLIALPLAAQAASFDCKQARQADERAICASRALSEQDVEMSVRYEMLMGLVAMGTRGDMGEAQQQWLKRRARCGASQSCLATAYRERIDALKQQYRQLQSRGPF

SEQ ID NO: 3888 - protein, 98 aa, Burkholderia Sp.
MAAQAASFDCKEARQADERAICASRALSEQDVEMSVRYEMLMGLVAMGTRGDMGEAQQQWLKRRARCGASQSCLATAYRERIDALKQQYRQLQSRGPF

SEQ ID NO: 3889 - protein, 163 aa, Collimonas sp.
MKGFTPGLFDRLMGGDNTPAQSDLVVRLSMDALKDAVARDLEAMLNTRTVIPEEILKNFPECSQSILTYGLNDFSGMSLASMDDRAYICQCLEQGIARHEPRLRDVKASLELREGSINRLNFAIAAMLVVGPAKEAVSFDAVLQPSTLQYSISRARRAMRMDG

SEQ ID NO: 3890 - protein, 162 aa, Herbaspirillum sp.
MKGFAPSLFDRLMNDSARSAANPVISRLSIEELKDTVARDLEAMLNTRAVIPEDLLKNFPECGKSIVAYGLNDFAGMSLASIDDRNAICRSLEGAIARHEPRLRNVRATLEIREGAINRLNFAISALLVVNAAREAVSFDAVLQPSTLQYSISKTRPTRIGI

SEQ ID NO: 3891 - protein, 162 aa, Janthinobacterium sp.
MKGFTPGLFDRLMDTPVQGASSSTVSRLSLEDLKDTVARDLEALLNTRTVIPEALLKKFPECGRSIVTYGLNDFAGLSLSSSDDRAYICQCLEKAIARHEPRLRSVRASLEIQEGSINRLNFAITALLVVHSAQEPVNFDAILQPSSLHYTISKARRTAQGA

SEQ ID NO: 3892 - protein, 162 aa, Janthinobacterium sp.
MKGFTPGLFDRLMDTPVQGASSSTVSRLSLEDLKDTVARDLEALLNTRTVIPEALLTKFPECGRSIVTYGLNDFAGLSLSSSDDRAYICQCLEKAIARHEPRLRSVRASLEIQEGSINRLNFAITALLVVHSAQEPVNFDAILQPSSLHYTISKARRTAQGA

SEQ ID NO: 3893 - protein, 163 aa, Oxalobacteraceae sp.
MKGFTPGLFDRLMDMPVNGASSGTVSRLSIEDLKDSVARDLEALLNTRTVIPEELLKRYPECGRSIVTYGLNDFAGLSLSSTDDRAFICRCLEKAIARHEPRLRNVQASLELRADSINRLNFAITALLVVSSAHEPVNFDAVLQPSSLHYTISKARRVAQSGA

SEQ ID NO: 3894 - protein, 757 aa, Collimonas sp.
MKKYHRLTCRLYFSMVVAGVLPAAAHANAVLQNPFWRVALDPATLAIRVTPADGPEVAVSNGVDAHKVSSLHVAVDEASWRWDERADNGYAIEAKLTERDLALTIRAKGTGQLALIRQPGQAIGRGLILPLTEGRYVARDNKVWNDFILQHMERINATQDLSLPLWGLDHGKFTLNWLLTNPFNNQLDFSADKNGDGVALKVSHTFTTLSADTPMTLILHLGEADPLAGAKRYRAWLKETGRFESLADKIAKTPDAAKLIGASHIYLWGSGLIAAKDIRDWPVFLTALRGKDGLAQDLRRTFDRESKSVLAQASAKPDRYQQKVIIRAFNGAINALARAAWQVDEPDVGLLANRYGELRAQVARTFSAALSKDPAGWGDGVSVNTMSQLQAAGLPRLWIGLGEGWEGGLWHPEAIAAGVKAGYMVAPYDSYETALPRGDNPDWATAHLGEKAYRDCAIVQQDGTFKSGFNQSGHYTNPLCMRPLLEARVRALQEKTGFNSWFLDAYATGMVFDDYRKAAPMSMAQNAIANVDSSRWISQDRQMPTGSEDGNATTSQGIFFAHGMQTPVIGWGDKDMQKDKTSPYYLGKYYPPEEPEVMFKAVPLKELYRKVDFDPAARLPLYQAVFHDSVITTHHWLFDSLKLNNVRMENELAQLLYNVPPLFHLSSATFKARLPLMQRQDAFFRPLHQRLATQALTGFRWLSTDKMLQETSFADGTTLVVNFSDSERQAEGRRFKPYSMTARFNDGSTSIYAADKK

SEQ ID NO: 3895 - protein, 515 aa, Collimonas sp.
MRTKAGVKIGGALMLGLVGSLLAGCGDGGGSTDAAGASQKQLVATAKASVTACAAAWDANTIYVGGNSASANSTNYTANWWTQGNNPVTDSGGSGSGKPWTSTGACGSGTPTPPPVAPPPVTPPPVNPPPAMPGTTTGTINYHLLLGAGSAQDQMVLDGGNYNDLIMSNIIAGVMYGHLVQQYYPGMQFQKDYLYGSIMGQLLQENIETSLYASSSDLIDPSPDQQAVMGAGQGGPYQINNYAADMVSGSYAPAGHSLINYVAIQKNIGYTMATAAQQYTKVTPPSFNNKYYGPMLTAYFHYNDFVALILTGKGTGGWTTPWEPYYDNALANFTKLPNNFLDVLLNVAYNQGYYGTLMTSYSKLGATATAATVASVNAYSSVWGVTDTYQQYPYQVRYYLDQLYGNPIPTTSATTFTTPANHVAFNIPALETVFSNVFQTLAYVNSSGTSVYISAAQAQTAFNSALASVGVAGSATLDLSNGANRAQIFSILETAIGNLETNLNTKFSATTSAQL

SEQ ID NO: 3896 - protein, 506 aa, Collimonas sp.
MRTKIGDALLLGLFGVMLAGCSDGGSSQDAANASQKPLSPGAKASAPACATAWNANAVYVGGNSVSDNGTNYTANWWTQGNNPATDSGGSGSGKPWTSTGACGSGTPAPPVTPPVTPPVTPPTPGSTVGTISYHLLLGAGSAQDQLILDGGNYNDLIMSNIIAGVMYGHLVQEYYPGMQFQKDYLYGSIMGQLLQENIETGLYVNTGNLIDPSPDQQAVMGAGQGGPYQINNYAADMVSGSYTPAGHSLINYIAIQKNIGYTMAAAPQQYTKATPPSFNNKYYGPMLTAYFHYNDFVALILTGKGTGGWVTPWQPYYDNTLINFTTLPNNFLDVLLNVAYNQGYYGTLMTSYSKLGATATAATVAAVNAYSAIWGVTDTYQQYPYQVRYYLDQFYGNPIPTTSATTFATPANHVAFNIATLETVFANVFQTLAYVNGTGQSVYITSAQAQTAFNSALASSGVSASGTLDLSTATDRAQIFSVLESAIGNLETNLGTKFNATTNVQL

SEQ ID NO: 3897 - protein, 420 aa, Collimonas Sp.
MKLPAAWLIPVCGVLAASQASAWEKYGIHSVYPAAISVQINPSQISNQQLAAIKDAGFEYVRFGTRPPVSDKPQDFSELLERLRKAQLKPIITLFGGATVWVQPKRMMSATMTPLDAADNFSKFALTTLNQYSDPNILWELWNEPDNPTFLKPGMLQAGLVPAIQKICSALEQQKGGVKKNIFGFGFAKLPNLQPKIPDDKLLAISLQNCLSGVSVHPYRKIPETLADDATKSRELLHKYGKGELPMIASEWGYSNFTAARDQGGQAQLVLREYLSTVFAGIPLVNIYQWQDTGPDRAAREQNYGLTDSSGQVKQALPALKHLLGKLKDTQLAGSEKVGEAYQLVLNSQPGASAKRSVHVVWSSAAHSGPGGGFSIPRNKGQRCVISEFYPQQGDKPCPEGAGNVDINAGPSPLAVTLYD

SEQ ID NO: 3898 - protein, 764 aa, Collimonas sp.
MAWAALALGLLHVNAAIATDTSAADAKAVTAEVHGRPRIGLVLSGGGARGYAHLGVLKALEQMHIPIDYVAATSMGAVVGGLYASGLSADELDHILTGTNLSDIAFDRNERAELPQSQREDDFQYPIGLSAGYGDGKLKLPAGLVQGNNLLALLQNWTPQLPANISFDKLPTPFRAVATDLGSGAEVILKQGSLPRAIRASMAVPGLFAPLKLDGHTLVDGGLVRNLPVQLARDMGADIIIAVNIATDLQDPSTLDSPTAVAQQMVTILIRQNVKQQIGLLKKGDVLIEPDLGDLSFADFSRGKDGVAAGYAAAQKQRAKLEALALPPEQWKSYLAGRSGGPVLAQETRIDKIEINSHGPVPAAAVRRSLDVNEGDFYNPVALNQDMARLSTNGDFKSVTQELVTEDGINVLKVDADAKSWGPHFLLFGLGVSNSFNGRGDFNLQIGHRLPWITDSGLEWRNDVVLGSKQASLHTELRQPIWNTVGLYVAPYAEYGRRHLDIYSDDNNATAATVPVTAYRVDTTKVGVDLGIPIGRLGEFRAGVNYQWLVAAPSYNIPLGSDGSASDGLFDSFRIKQPVVSAKLTVDQLDDPLFPRKGYYVSAISNVGLGGADNRYSDAQAKGLWAVSHGGNTLNFALEAAGTYGNEENGVSGNGGLGFSLGGFQHLSAYAPDQFTGNYLLYGRLTYLRDMPDLDLPGLRSTVLGTSLEAGDVWQTRTAFGTGPLKKSASMFLGGNSFLGPVYFGLALAPRGVWNLYLQLGRVF

SEQ ID NO: 3899 - protein, 723 aa, Collimonas sp.
MLSGGGARGYAHLGVLQALEKMHIPIDYVAATSMGAVVGGLYASGLSVDELDHILSGTNLSDIAFDRNERADLPQRQREDDYQYPIGLSAGYGDGKLKLPAGLVQGNNLLALLQNWMPQLPANISFDKLPTPFRAVATDLGSGEEVILDHGSLPRAIRASMAVPGLFAPLKLDGRTLVDGGLVRNLPVDQARAMGADIIIAVNIAADLQDPTTLESPTAVAQQMVTILIRQNVKRQVDSLKKDDILIEPDMGDLGFADFSRGNDGVKAGYDAAERQRAKLAPLALPPEQWKAYLAARSGGPVLAQDTRIDSIEINSKGRVPAAVVRRSLNVKEGDFYNPIALNKDMASLSTNGDFKSVTQELVTENGRNVLKVDAEEKSWGPNFLLFGLGVSNSFNGRGDFNLQVGHRLPWITDSGLEWRNDIVLGSKQASLHTELRQPIWNTVGLYVAPYAEYARRHIDLYLDEGSVTSSTVPVTAYRVDTTKVGIDLGMPIGRLGELRTGVYYQWLEARPTYNLPMDFTQIAPGLVFSSFRVKQPVVSTQLIVDQLDDPLFPRKGYYLSAISNLAFGGADNSYSDAQGKALWAISRGGNTLNLALEAAGTYGNEQSGASQNGGLGFTLGGFQHLSAYAPDQFSGNYLLYGRMTYLRDMPGLDLPGLRSAVLGTSLEVGDVWQTKDAFASGPFKKSVSMFLGGNSFLGPLYFGAAIAPRGIWNLYLQLGRVF

SEQ ID NO: 3900 - protein, 626 aa, Collimonas sp.
MKSKVPAGNFAIPQVSALSLALSLVFASLSVHAAVADTGTWVATKTQAFLPQVQANQKSLAADASIATPAASAVQLAQGEPVHVTLSLNLRNEAKLDKFLQDLHTPGTASYGKFLKPAQFAALYAPTEKDVAAVVAHLSKSGFVNIRIAPNRQLVFADGTAATVQTAFRTSLKRFQQDGRKVFANTDAAQVPAALGNIVGSVLGLQNVAVAQTHHRWIPNAQGSVALQAKAKPSATPIATPHSPAQFPAIYNAGSTPTASNTTVAIISEGNIDPTISDLGTFTSANGFATVNTSVVQTGPAGSDYSDTSGQVEWNLDSQTITGTSGGAVQQLIFYASPDMNFSSITASYNQAVSDNLAKVINVSLGGCESDTHSDGTQAADDNVFKQAVAQGQTFSISTGDAGTYNCQTSSISGAPGVPKNKSTYDVSEPASSPYVIAVGGTTLYTASGAYSSETVWNEGLSAIGVYDANGDSDPTKRLWATGGGYSKYEAAPSYQSGVIAAGKTTRGLPDIAFDAASASGATIYYNGQTGTVGGTSLAAPIFTGTWARLQSANGNALGFPAASFYKYFPLAANAALLHDVTSGTNGASSSYGYKAAKGWDATTGFGSLNIANLNTFIQNTSDFAR

SEQ ID NO: 3901 - protein, 628 aa, Collimonas sp.
MKSESSAKVAGSFKIPQVTALSLALSLVFASMAAHAAVVDNTTWVATKTQAFLPQVQANQKSVAADASVQTPAESAVQLAQGEPVHVTLSLNLRNEAQLDQFLQELRTPGSASYGKFLTSAQFAEKYAPTEKDVAAVVAHLSKAGFVNISVSPNRQLVSADGTAATVQTGFRTALKRFQQDGRKVFANTDAAQVPATLSGIVGSVLGLQNVAIAQTHHRFVPDAAGSARLQATAKPSATPVATPHSPAEFPAIYNAGSTPTGSNTIVGIISEGDITPTITDLKAFTTAKGLATVSTSVVQTGPSGSDYSDTSGQVEWNLDSQTITGTSGGVRKLIFYASPDMQFSSITTSYNKAVTDNVAKVINVSLGGCESDTHSDGTQAADDNVFKQAVAQGQTFSISTGDAGTYNCQTSSISGAPGVPKNKSTYDVSEPASSPYVIAVGGTTLYTNAGAYSSETVWNEGLSPIGVYDSQGDSDPTKRLWATGGGFSKYEAAPSYQKGVITAGKTTRGLPDIAFDAASASGATIYYNGQTGTVGGTSLAAPIFTGTWARLQSANGNALGFPAASFYKYFPLAANASLLHDVISGTNGASSSYGYKAGKGWDATTGFGSLNIANLNTFIKNTSDFAR

SEQ ID NO: 3902 - protein, 635 aa, Collimonas sp.
MKSETSAKTAAGSFAVPRASVLSLALSLALASLSVHAATNDTWVATKTKAFLPQVQAKQKSAAVDASVQTSAEAAVQMAQGEPVHVTLSLNLRNEAKLDKFLRELRTPGSRVHNKFLTPAQFKAEYAPTEKDVVTVVAHLRKAGFVNIKVAPNRQLVTADGTAATVQAGFHTALKRFEQDGRKVFANTDAAQVPAALGHIVGSVLGLQNVALAHTNHVMLPAAKANASLFAKARTNATPIATSHSPAEFPGIYNAGSTPTAANTTVAVISEGDLTQTIADLNTFTANNNFATVNTNVVQTGPDGSDYSDTSGMVEWNLDSQTITGTSGGAVQQLIFYASPDMQFSSITASYNQAVSDNLAKVINVSLGGCESDTNSDGTQAADDNVFKQAVAQGQTFSVSTGDAGAYNCQTSSISGQPGVPTNKAAYDVSEPAASPYVIAVGGTTLYTTSGSYSSETVWNEGLRAIGQYDAAGDVDNTKRIWATGGGYSKFEAAPSYQSGVTATGATTRGLPDIAFDAASASGANLVINGSTTNQNGNLYTVGGTSLAAPIFTGVWARMQSANNNGLGFPAASFYKYFPQSANASLLHDVTSGTNGYSSSYGYKAGKGWDAVTGFGSLNISNLNSFIANTSDFAR

SEQ ID NO: 3903 - protein, 183 aa, Collimonas Sp.
MTINKILATMLIGVAGFSGTSLALAADSAKASYKAAEDAADTTYKADKAKCDELSGNGKDVCLKQAKATREHAKQDAKAEYKNTPKAVASARKSEADADYAVAKEKCDGLAGNAKDVCVKQAKADQTNAVANANTQKDVSKAKADAREERADARYKVAMAKCDALAGAAKDDCVAAAKAELGK

SEQ ID NO: 3904 - protein, 183 aa, Collimonas Sp.
MKIKKIIAGVLIGVAGFSGASLALAADGSKASYSAAQDAADATYKADRARCDSLSGNGKDVCVKQAEATREHSKQDAKAEYKNTPKALASARKSEADADYAVAREKCDSLAGNAKDVCIKQAKAGQANAVANADKQLEITKANADAREERADARYKVALAKCDALAGAAKDDCVTTAKAALNK

SEQ ID NO: 3905 - protein, 93 aa, Collimonas Sp.
MSLPATLQARYLSLTARMKIYGPHLGEPHTKVLGNGLLELRLKGAEGIARVFYCTMVGKQIVMLHSFVKKTQKIPFKEKRIAEIRMREVKNER

SEQ ID NO: 3906 - protein, 496 aa, Collimonas sp.
MQSPQRILLAALVSVCCALPLPSALAIQNLPTLGDSARESLPPLMERKLGEEIMHDIRRDPDYMNDAPLLEYLNNFGWTLVAARPEVRGEAGFDFFFFAVRDPVLNAFALPGGFIGVHSGLILAAQSESELASVLAHEIGHVAQRHIARMLGSQKQDSMIALASMLLGALAMRGSGDAGAAVMMGGTGLAMQRQLNFSRDAEREADRIGLSILDSGGFDTSGMVAFFGRMQTASRNYSDAIPPYLLTHPLTTERIADIEARIREQRYRQRADNLDFQLIRARVRVLQDDTELGRRDAQYVFEAQLNLYTKQQIVAAKYGMAFLAFKKEDYAKAEDLLNQAVAAAAPAKQSLVLTDLGIEIMLATKREAEALKLVEQAQVQFPLSRGLAHQYARVLIASKRLDEVTKYLREQAQIYRQDADVQDLLAKAYSAQGKRALQHMALAESYVLTGSVPAALDQLRIARNSPDAGFYDQSMIDARERELQERWKEEVKASKE

SEQ ID NO: 3907 - protein, 482 aa, Collimonas sp.
MCCALPLPSALAIQNLPTLGDSARESLPPLMERKLGEEIMHDIRRDPDYMNDAPLLEYLNNFGWTLVAARPEVRGEAGFDFFFFAVRDPVLNAFALPGGFIGVHSGLILAAQSESELASVLAHEIGHVAQRHIARMLGSQKQDSMIALASMLLGALAMRGSGDAGAAVMMGGTGLAMQRQLNFSRDAEREADRIGLSILDSGGFDTSGMVAFFGRMQTASRNYSDAIPPYLLTHPLTTERIADIEARIREQRYRQRADNLDFQLIRARVRVLQDDTELGRRDAQYVFEAQLNLYTKQQIVAAKYGMAFLAFKKEDYAKAEDLLNQAVAAAAPAKQSLVLTDLGIEIMLATKREAEALKLVEQAQVQFPLSRGLAHQYARVLIASKRLDEVTKYLREQAQIYRQDADVQDLLAKAYSAQGKRALQHMALAESYVLTGSVPAALDQLRIARNSPDAGFYDQSMIDARERELQERWKEEVKASKE

SEQ ID NO: 3908 - protein, 479 aa, Collimonas sp.
MPYAPAAAAQNLPTLGDTSRETLSPLMERKLGEEVMHDIRRDPDYMTDAPLLEYLNNFGWTLVNARPDVRGEAGFDFFFFAVRDPVLNAFALPGGFIGVHSGLLLAAQSESELASVLAHEIGHVAQRHIARMVGSQKQDSMIALASMLLGLLTMRGSPDAGAAVMMGGTGLAMQRQLNFSRDAEREADRIGLSILDAGGFDTSGMVVFFGRLQTASRNYSDAVPPYLLTHPLTTERIADIEARIREQRYRQHADSLDFQLIRARVRVLQDDTELGRREAQFFFETQLKQNTKQQIVAAKYGMAFLAFKQEDYGKAEALLEEAMAAAAPARKNLVLTDLGIEIMLATKREAEALKLVEQAQLQYPLSRGLAHQYARVLIASKRLDEATKYLREQAQLYRQDADVQDLLAQAYSAQGKRALQHMALAESYVLTGSVPAALDQLRIARNAPDAGFYDQSMIDARERELQARWKEELQASKDR

SEQ ID NO: 3909 - protein, 381 aa, Collimonas sp.
MKKILAALAATVLSISAAFAQTLPPPTVAAKSWLLLDTTSNQVVAAQDPDMRIEPASLAKIMTAYVVFGALRDKKISLDQMVNVSVRAWKVDPSSSKMFIDPATPVSVNDLLYGLMVVSGNDAAVALAEAVAGTEDSFVALMNHEAERMGMKSTHFGNPHGLPSADTYSTARDLSTLAAHVIVDFPEFYKIDSTKKYTYNKITQPNRNRLLWLDPTVDGMKTGHTSSAGYSIIASAKRPNAGGDRRLLAVVIGTDSDSIRTQEAQKLLNWGFQNFDAVKLYSKGQAVDTPQVWKGAKSQIKIGFNHDVYVTVPKGIADKIKPVLERTDPLIAPIQQNAKVGTLKVNADGKTIAEFPVLALEGVNQASIFGRAWDSIRLMFK

SEQ ID NO: 3910 - protein, 423 aa, Collimonas sp.
MRLFARRLHPLIFSTIHANKVAQYPHWQLHNFVGTDFITRYSMKKILAALAATVLSISAAFAQTLPPPTVAAKSWLLLDTTSNQVVAAQDPDMRIEPASLAKIMTAYVVFGALRDKKISLDQMVNVSVRAWKVDPSSSKMFIDPATPVSVNDLLYGLMVVSGNDAAVALAEAVAGTEDSFVALMNHEAERMGMKSTHFGNPHGLPSADTYSTARDLSTLAAHVIVDFPEFYKIDSTKKYTYNKITQPNRNRLLWLDPTVDGMKTGHTSSAGYSIIASAKRPNAGGDRRLLAVVIGTDSDSIRTQEAQKLLNWGFQNFDAVKLYSKGQAVDTPQVWKGAKSQIKIGFNHDVYVTVPKGIADKIKPVLERTDPLIAPIQQNAKVGTLKVNADGKTIAEFPVLALEGVNQASIFGRAWDSIRLMFK

SEQ ID NO: 3911 - protein, 381 aa, Herminiimonas sp.
MKKIFAAFAASVLSLSVAVAQTLPSPNIAARSWLLLDMNSNQVIAAQDPDMRIEPASLTKIMTAYLTFAAVKDKKLALNQMVTVSEHAWKVDPSSSKMFIDPRVPVSVNDLLYGLMVQSGNDAAVALAEAVSGTEDAFVVLMNREAQRMGMKNTRFGNPHGLPSAENYSTARDLSLLAEHIIADYPEFYKIDSTKYFTYNNIKQPNRNRLLWSDPSVDGMKTGHTAGSGYSMIASAKRPNGNSQRRLLSVLSGATSDQLRAQESQKLLNWGFQNFEAVKLYSKDQAIATPQVWKGAQGQLKIGFNRDVFVTLPKGTADKLKPVLERRDPLVAPINQNSKVGTLKMMVDGKVVTELPVLALEQVNQASIFGRAWDSLRLWLK

SEQ ID NO: 3912 - protein, 381 aa, Duganella sp.
MKKIIAALATSVMLMSAAVAQTLPPPTIAAKSWLLLDATSGQIIASQDPNARIEPASLTKIMTAYVTFGALRDKKIDLKQMVNVSTKAWKVDSSSSKMFIDPATPVSINDLLYGLMVQSGNDAAVALAEAVAGDESAFVVMMNKEAQRMGLTNTRFANPHGLPSPENYSTAQDLSVLAKRVILDFPEFYKIDSVKSFTYNKITQPNRNRLLWLDPTVDGMKTGHTEAAGYCMIASAHRPNGAGERRLVSVVLGTSSDQSRTQESQKLLNWGFQNFDTVKLYSKGQAIATPEIWKGSKGVVKIGFANDVLVTVPKGVAAKMKPLLERKDPLVAPLAENSRVGSLKMMVDGKPLLELPVVALETVDQASIFGRAWDSIRLWLK

SEQ ID NO: 3913 - protein, 382 aa, Janthinobacterium sp.
MKKLLAAIAATVLSLSSAFAQSVPSPTINAKSWLLLDATSNQVLASNEPDMRIEPASLTKLMTAYVAFTAIQDKKLDLNQMITISTNAWKVDPSSSKMFIEPRVPVKVNDLLYGLIVQSGNDAAVAIAEAVAGTEDAFVALMNREAERMGMKSTHFANPHGLPSASNYSTARDLSVLASHLINDHPEFYKIYSTKEYTYNNIKQPNRNRLLWLDPTVDGMKTGYTQGAGYCLISTAKRPNGTGERRLISVVLGTISDQARAQESQKLLNWGFLNFDTVKLYAKNEPIATPNVWKGTQNSIKIGFTRDVYITVPKGVANTMKPVLARKDPLVAPIDKNSQVGTIKVMSADGKVVSELPVLALEQVGQAGLFGRALDSIRLWVH

SEQ ID NO: 3914 - protein, 381 aa, Massilia sp.
MKKLLAAFAASLVMVSASAQTVPAPTIAAKSWLLLDATSGQVIASQDQNARIEPASLTKVMTAYVTFAAIREKRLALNQMVNVSTRAWKVDGSSSKMFIDPATPVSVNDLLHGLMIQSGNDAAVALAEAVAGDEGTFVTLMNREAERMGLKGTRFANPHGLPDANNYSTAHDLSMLAANVIRDFPEFYKIDSVKQFTYNKITQQNRNRLLWLDPTVDGMKTGHTDSSGYSMIASARRPNGTTGQRRLISVVLGTPSDSVRTQESQKLLNWGFQNFDTVKLYSKGQAIATPEVWKGSQSNVKIGFTRDILVTVPKGVAGKLKPVLERKDPLVAPLARNGQVGTLKMMADGKPLLVLPVVALEEVQEASIFGRAWDSVRLWLQ

SEQ ID NO: 3915 - protein, 403 aa, Oxalobacteraceae sp.
MFHHAMALPARRLPLTLMKIFIAALAATVISLSSVFVQPASAQTMPAPIVAAKSWLLLDTTSGQVLASQDPTMRIEPASLTKIMTAYVTFQAIKEKRLDLAQMVNVSVRAWKVDPSSSKMFIDPATPVSVDDLLHGLMVQSGNDAAVALAEAVAGTEEAFVVLMNREAKRMGLTNTQFGNPHGLPSQSNYSTAQDLSKLAAAVITDYPEFYKIDSVKSFTYNKITQPNRNRLLWLDPSVDGMKTGHTEAAGYCIIASAKRPNGSGERRLISVVLGANSDQSRTQESQKLLNWGFQNFDTVKLYGKGQPVETPPVWKGSEKTIKIGFTQDIYVTVAKGVAAKMKPVLERKDPLVAPIAANSKVGMMKMMVDGKSIAEFPILALENVNEAGIFGRAWDSIRLWIQ

SEQ ID NO: 3916 - protein, 102 aa, Microbispora sp.
MKRFVLVPALTAATIAISAGAAYASQYVAYEGPGFSGRSVVIDRCGVSNIPFHGSYRWYGDGQSGRMYNQPDAQGVAHFTLAADRNAEQRTPVGWKSIFIVC

SEQ ID NO: 3917 - protein, 481 aa, unknown
  environmental sample
MDDKDGTPYRVEQLGPPRGRAGLQINEPVADFDGLATHHPGDNRHAKLRDGLVVDGQSGRLHAVIGGEIQEIEMARGGRDFGGLKPDQVLLKKDFLLEDSTKPRGSGRDVDVPAPMDGYVQRVSRGEGLVDIYDRKDGDLIARVRHMSKIPDLEGKQVVYGQTLGQQDDVATKGKHVHLEMDTRYHRQFENYVADLTEGRFKLEPEHREGVRPRPVMDDGTLRLGESSTRIRDLQEHLNGLGYIGADGEALTADGVYRLSMQRAVLDYQREQCLPQTGDIGREMLQAVPARTPEPFDPALSGIPAQGLPHAPMPHPFGTGPDDRPCAPPTPQQIEDAAERRRPLDPVFSAAPPSISSDPLVQSIRERLPQAFASHGAVPPDADLDRIAAGLAVECCKQGIERPDHIVVGNPAADGSGRHVFAVVGDLRDPASHRVDVAGQAAAQVPVEASLRKLDALQASTPALVQADQAQEQQKASIMRV

SEQ ID NO: 3918 - protein, 269 aa, unknown
  environmental sample
MTHTTRTPTLAMAACVLAALALIGCSSTVVREPSRGGHSRPGTSVRPGGSRPSTTPPASKPKYGATYTVQRGEGLYRIAANNGIQLADLAAWNNLSPPYNLYPGQRLRLYPSNGSRPPASSGSSSAGTTPPRTSTPAPTPAAPINSGIRWRWPADGPLLGRYVANEPTKQGVDIGGASGTPVRAAADGVVVYSGTGLVGYGELIIVKHNEQWLSAYGHNRKRLVNEGQLVKAGEQIAEMGRSGAARDMLHFEVRYNAKPVDPLLYLPAK

SEQ ID NO: 3919 - protein, 270 aa, Lysobacter sp.
MTHTTRTPTLAMAACVLAALALIGCSSTVVREPSRGGHSRPGTSARPGGSRPSTPSQPASKPKYGATYTVQRGEGLYRIAANNGIQLADLAAWNNLSPPYNLYPGQRLRLYPSNGSRPPASSGSSSAGTTPPRTSTPAPTPAAPINSGIRWRWPADGPLLGRYVANEPTKQGVDIGGASGTPVRAAADGVVVYSGTGLVGYGELIIVKHNEQWLSAYGHNRKRLVNEGQLVKAGEQIAEMGRSGAARDMLHFEVRYNAKPVDPLLYLPAK

SEQ ID NO: 3920 - protein, 269 aa, Lysobacter sp.
MTHTTRTPTLAMAACVLAALALIGCSSTVVREPSRGGHSRPGTSARPGGSRPSTTPPASKPKYGATYTVQRGEGLYRIAANNGIQLADLAAWNSLSPPYNLYPGQRLRLYPSNGSRPPASSGSSSAGTAPPRTSTPAPTPAAPINSGIRWRWPADGPLLGRYVANEPTKQGVDIGGASGTPVRAAADGVVVYSGTGLVGYGELIIVKHNEQWLSAYGHNRKRLVNEGQLVKAGEQIAEMGRSGAARDMLHFEVRYNAKPVDPLLYLPAK

SEQ ID NO: 3921 - protein, 265 aa, Lysobacter sp.
MSETTRTPTLAMAACVLASLVLIGCSSTVVREPSRGGSSRPGARPPASRPAPRPSTPKYGATVTVQRGEGLYRIATNHGIAMSDLAAWNGLSAPYNLYPGQRLRLYPPGGRAPSGGSGSSSASTGTPPRTAPAPVPAAPVNSGIRWRWPADGPLLGRYVANEPTKQGIDIGGASGAPVRAAADGVVVYSGTGLVGYGELVIVKHNEQWLSAYGHNRKRLVNEGQVVKSGEQIAEMGRSGAARDMLHFEVRYNAKPVDPLLYLPAK

SEQ ID NO: 3922 - protein, 264 aa, Lysobacter sp.
MIKTTRTPTLAMAACVLAALALIGCSSTVVREPSRGHSSRGPSRPSSRPAPPRPSRPKPGATVVVQRGEGLYRIATNNGIQVADLAAWNGLSPPYTLYPGQRLRLYPPSGGARPSAGTPSSGGTSAPRPTPAAPVAAPVNSGIRWRWPADGPLLSRYVANEPTKQGVDIGGSSGAAVRAAADGVVVYSGTGLVGYGELIIVKHNEQWLSAYGHNRKRLVNEGQVVKSGEQIAEMGRSGAARDMLHFEVRYNAKPVDPLLYLPAK

SEQ ID NO: 3923 - protein, 263 aa, unknown
  environmental sample
MSETTRTPTLAMAACLLATLALIGCSSTVVREPSRGGSRGGGSRPSTPAQRPSVAKPGATVIVQRGEGLYRIAVNNGIQLADLAAWNGLSPPYSLYPGQRLKLYPPGRGGSSSSGSSSSGGSTATRPSAPAPAPAAPIDSGIRWRWPADGPLLGRFVANEPTKQGVDIGGAPGTPVRAAADGVVVYSGTGLVGYGELIIVKHNEQWLSAYGHNRKRLVNEGQLVKAGEQIAEMGRSGAARDQLHFEVRYNAKPVDPLLYLPAK

SEQ ID NO: 3924 - protein, 262 aa, unknown
  environmental sample
MSETTRTPTLAMAACLLATLALIGCSSSVVREPSRGGSRGGASRPSTPAQRPSVAKPGATVVVQRGEGLYRIATNNGIQLADLAAWNGLSPPYSLYPGQRLKLYPPGRGSSSSGSSSSGGSSATRPSAPAPAPAAPIDSGIRWRWPADGPLLGRFVANEPTKQGVDIGGAPGTPVRAAADGVVVYSGTGLVGYGELIIVKHNEQWLSAYGHNRKRLVNEGQLVKAGEQIAEMGRSGAARDQLHFEVRYNAKPVDPLLYLPAK

SEQ ID NO: 3925 - protein, 260 aa, unknown
  environmental sample
MSETNRTPTLAMAACLLATLALIGCSSSVVREPSRGGSRGGRPATPAQRPSVAKPGATVVVQRGEGLYRIAANNGIQMADLAAWNGLSPPYNLYPGQRLKLYPPGRGSSSSSGSSSAGSTATRPSAPAPAPAAPIDSGIRWRWPADGPLLGRYVANEPTKQGIDIGGAPGTPVRAAADGVVVYSGTGLVGYGELIIVKHNEQWLSAYGHNRKRLVNEGQLVKSGQQIAEMGRSGAARDQLHFEVRYNAKPVDPLLYLPAK

SEQ ID NO: 3926 - protein, 256 aa, Lysobacter sp.
MSETNRTPTLAMAACLLATLALIGCSSSVVREPSRGGRPAAPAQRPSVAKPGATVVVQRGEGLYRIAANNGIQMADLAAWNGLSPPYNLYPGQRLKLYPPGRGGSSSAGSSSAGSGGSRPSAPAPAPAAPIDSGIRWRWPADGPLLGRYVANEPTKQGIDIGGAPGTPVRAAADGVVVYSGTGLVGYGELIIVKHNEQWLSAYGHNRKRLVNEGQLVKSGQQIAEMGRSGAARDQLHFEVRYNAKPVDPLLYLPAK

SEQ ID NO: 3927 - protein, 254 aa, Lysobacter sp.
MAACVLAALALIGCSSTVVREPSRGHSSRGPSRPSSRPAPPRPSRPKPGATIVVQRGEGLYRIATNNGIQVADLAAWNGLSPPYTLYPGQRLRLYPSSGGGTRPSPGAPSSAGTSAPRPVPAAPVAAPINSGIRWRWPADGPLLSRYVANEPTKQGVDIAGSSGAAVRAAADGVVVYSGTGLVGYGELIIVKHNEQWLSAYGHNRKRLVNEGQVVKSGEQIAEMGRSGAARDMLHFEVRYNAKPVDPLLYLPAK

SEQ ID NO: 3928 - protein, 334 aa, Paenibacillus sp.
MYKTKFLMILLSFTVIASFSSLSGPSPSKAFAEENGTPVQKTIDLNEGFDHSNEASIEPLSLTSEEATSQATVTAIDHDANFSPSTLQFLKANTGLDGEQWDNIMKLVNKPEQDSLKWTEFYGYAEDIGDNRGYTIGIFGATTGGSNDTGPDGPDLFKAFDAASGASNPSIAGGLTRAGLKGKMSGSILKLSDSDSVIKKKINALQNNEAWREAMWRTFYDTYIEYSVQQAQKRGFNTALTIGSFVDTALNQGATGDSGSLEGILSRSGSSTNEKKFMTSFYAKRTLVVDTNDYNQPPNGKNRVKQWSSLLASGETDLKNADAAVIKATNWELK

SEQ ID NO: 3929 - protein, 334 aa, Paenibacillus sp.
MYKIKFLMILLSFTVVASFSSLSGSSPSKAFAEENGTPVQKTIDLNEGFDNSNEASIQPLSLTSEEATSQAAVTAIDHDANFSPSTLQFLKANTGLDGEQWDNIMKLVNKPEQDSLKWTEFYGYAEDIGDNRGYTIGIFGATTGGSNDTGPDGPYLFKAFDAASGASNPSIAGGLTRAGLKGKMNGSILKLSDSDSVIKKKINALQNNEAWREAMWRTFYDTYIEYSVQQAHKRGFNTALTIGSFVDTALNQGATGDSGSLEGILSRSGSSTNEKNFMTSFYAKRTLVVDTNDYNQPPNGKNRVKQWSSLLASGETDLKNADAAVIKATNWELK

SEQ ID NO: 3930 - protein, 334 aa, Paenibacillus sp.
MYKIKFLMILLSFTVVASFSSLSGSSPSKAFAEENGTPVQKTIDLNEGFDNSNEASIQPLSLTSEEATSQAAVTAIDHDANFSPSTLQFLKANTGLDGEQWDNIMKLVNKPEQDSLKWTEFYGYAEDIGDNRGYTIGIFGATTGGSNDTGPDGPYLFKAFDAASGASNPSIAGGLTCAGLKGKMNGSILKLSDSDSVIKKKINALQNNEAWREAMWRTFYDTYIEYSVQQAHKRGFNTALTIGSFVDTALNQGATGDSGSLEGILSRSGSSTNEKNFMTSFYAKRTLVVDTNDYNQPPNGKNRVKQWSSLLASGETDLKNADAAVIKATNWELK

SEQ ID NO: 3931 - protein, 342 aa, Paenibacillus sp.
MYKISNKLISNKTKFLMILLSFTVIASFSSLSGPPAKAFAEENGTPVQKTIDLNEDFDNSNEASIEPLSLTSEAATSQEAVTAIDHDANFSPSTLQFLKANTGLDGEQWDNIMKLVNKPEQDSLKWTEFYGYAEDIGDNRGYTIGIFGATTGGSNDTGPDGPDLFKAFDAASGASNPSIAGGLTRAGLKGKMSGSILKLSDSDSVIKKKINALQNNEAWREAMWRTFYDTYIEYSVQQAQKRGFNTALTIGSFVDTALNQGATGDSGSLEGILSRSGSSTNEKKFMTSFYAKRTLVVDTNDYNQPPNGKNRVKQWSSLLASGETDLKNADAAVIKATNWELK

SEQ ID NO: 3932 - protein, 343 aa, Paenibacillus sp.
MYKISNKLISNKTKFLMILLSFSVIASFSSLSGPSPTKAFAEENGTPVQRTIDLNEGFDNSNEASIEPLSLTSEEATSQGAVTAIDHDANFSPSTLQFLKANTGLDGEQWDNIMKLVNKPEQDSLKWTEFYGYAEDMGDNRGYTIGIFGATTGGSNDTGPDGPDLFKAFDAASGASNPSIAGGLARAGLKGKMSGSILKLSDSDSVIKKKINALQNNEAWREAMWRTFYDTYIEYSVQQAQKRGFNTALTIGSFVDTALNQGATGDSGSLEGILSRSGSSTNEKKFMTSFYAKRTLVVDTNDYNQPPNGKNRVKQWSSLLASGETDLKNADAAVIKATNWELK

SEQ ID NO: 3933 - protein, 342 aa, Paenibacillus sp.
MYKTSDKLVSNKTKFFMILLSFTVIASFSSLSGPSPAKAFAEENGTTVQETVDLNEGDNSNEASTESLSLTNEEATSQAAVTATDHDANFSPSTLQFLKANTGLDGEQWDNIMKLVNKPEQDSLKWTEFYGYAEDIGDNRGYTIGIFGATTGGSNDTGPDGPDLFKAFDAASGASSPSIAGGLTRAGLKGKMSGSILKLSDSDSVIKKKIKALQNNEAWREAMWRTFYDTYIKYSVQQAQKRGFNTALTIGSFVDTALNQGATGDSGSLEGILSRSGSSTNEKTFMTNFYAKRTLIVDTNDYNQPPNGKNRVKQWSSLLASGETDLKNADAAVIKVTNWEMK

SEQ ID NO: 3934 - protein, 330 aa, Paenibacillus sp.
MSSKLISHKTKFFMILLSFSVIASFSSLYGPLPAKALAEENGTPVQETNESNIQQIPLTSEETTSQTAVTAIDHDANFSPSTLQFLKDNTGLDGEQWDNIMKLVNKPEQDSLKWTEFYGYAEDIGDDRGYTIGIFGATTGGSNDTGPDGPALFKAFDATSGASNPSIAGGLARAGLKGKMSGSILKLSDSDSVIKKKIKALQNNEAWREAMWRTFYDTYIEYSVQQARKRGFNTALTIGSFVDTALNQGATGDDGSLEGVLSRSGNSTNEKTFMTNFYAKRTLVVDTNDYNQPPNGKNRVKQWSSLLASGETDLKNADAAIIKVTNWEMK

SEQ ID NO: 3935 - protein, 333 aa, Paenibacillus sp.
MFKIRSKLISHKTKFFMILLSFSVIASFSSLYGPLPAKALAEENGTPVQETNESNIQQIPLTSEETTSQTAVTAIDHDANFSPSTLQFLKDNTGLDGEQWDNIMKLVNKPEQDSLKWTEFYGYAEDIGDDRGYTIGIFGATTGGSNDTGPDGPALFKAFDAASGASNPSIAGGLARAGLKGKMSGSILKLSDSDSVIKKKIKALQNNEAWREAMWRTFYDTYIEYSVQQARKRGFNTALTIGSFVDTALNQGATGDDGSLEGVLSRSGNSTNEKTFMTNFYAKRTLVVDTNDYNQPPNGKNRVKQWSSLLASGETDLKNADAAIIKVTNWEMK

SEQ ID NO: 3936 - protein, 333 aa, Paenibacillus sp.
MFKISSKLISHKTKFFMILLSFSVIASFSSLYGPLPAKALAEENGTPVQETNESNIQQIPLTSEETTSQTAVTAIDHDANFSPSTLQFLKDNTGLDGEQWDNIMKLVNKPEQDSLKWTEFYGYAEDIGDDRGYTIGIFGATTGGSNDTGPDGPALFKAFDAASGASNPSIAGGLARAGLKGKMSGSILKLSDSDSVIKKKIKALQNNEAWREAMWRTFYDTYIEYSVQQARKRGFNTALTIGSFVDTALNQGATGDDGSLEGVLSRSGNSTNEKTFMTNFYAKRTLVVDTNDYNQPPNGKNRVKQWSSLLASGETDLKNADVAIIKVTNWEMK

SEQ ID NO: 3937 - protein, 330 aa, Paenibacillus sp.
MSNKLISHKTKFFMILLSFSVIASFSSLCGPSPAKALAEENGTPLQETTETHIQQIPTTSEDTTSQTAVTTIDHDANFSPSTLQFLKDNTGLDGEQWDNIMKLVNKPEQDSLKWTEFYGYAEDIGDDRGYTIGIFGATTGGSNDTGPDGPALFKAFDAASGASNPSITGGLARAGLKGKMSGSILKLSDSDSVIKKKIKALQNNEAWREATWRTFYDTYIEYSVQQAKKRGFNTALTIGSFVDTALNQGATGDYGSLEGILSRSGNSTNEKTLMTNFYAKRTLVVDTNDYNQPPNGKNRVKQWSALLASGETDLKDADAAIIKVTNWEMQ

SEQ ID NO: 3938 - protein, 333 aa, Paenibacillus sp.
MFKISNKLISHKTKFFMILLSFSVIASFSSLCGPSPAKALAEENGTPLQETTETHIQQIPTTSEDTTSQTAVTTIDHDANFSPSTLQFLKDNTGLDGEQWDNIMKLVNKPEQDSLKWTEFYGYAEDIGDDRGYTIGIFGATTGGSNDTGPDGPALFKAFDAASGASNPSITGGLARAGLKGKMSGSILKLSDSDSVIKKKIKALQNNEAWREATWRTFYDTYIEYSVQQAKKRGFNTALTIGSFVDTALNQGATGDYGSLEGILSRSGNSTNEKTLMTNFYAKRTLVVDTNDYNQPPNGKNRVKQWSALLASGETDLKDADAAIIKVTNWEMQ

SEQ ID NO: 3939 - protein, 343 aa, Paenibacillus sp.
MYKTSNKPANHRVKFLMILLSFTVVASFSSFSGPIQTKAYADEDIAPIEENIDSSEIYNDANEANIQSFSVTDENSLSSVAAAAIDHDANFSASTLQFLKTNTKLDGEQWDNIMKLVNKPEQDSLKWTDFYGYAEDIGDNRGYTIGIFGATTGGSNDTGPDGPDLFKAFDAASGASSPSIAGGLTRAGLKGKMSGSILKLSDSDSVIKKKIKALQNNEAWREAMWRTFYDTYIKYSVQQAQKRGFTTALTIGSFVDTALNQGATGDSGSLEGVLSRSGSSTNEKTFMTNFYAKRTLIVDTNDYNQAPNGKNRVKQWSSLLAAGETDLKNADAAVIKATNWELK

SEQ ID NO: 3940 - protein, 343 aa, Paenibacillus sp.
MYKTSTKPATNRVKFFVIMLCFIVIASFSAMSSPIQTKAFADENIAPTEEYIDPSELYDDSNEVNTDSLSTIDEDVFSQEAITAIDHDANFSPVTLQFLKTNTGLNGEQWNNIMKLINKPEQDSLDWTKYYGYAEDIDDDRGYTIGIFGATTGGSNDTGPDGPALFKEFDAASGASNPSIQGGLTRAGIKGTMNGKILKITDSNSVFVKKINALQNNAVWREAMWRTFYNVYIKYSVQQAKNRGFNSALTIGSFVDAALNHGASGDSNSLEGILSRSGNSTNEKTFMTNFYAKRTLIVDTNEYNQPPNGKNRVKQWSSLLNSGETDLKNADAAVVKATKWTMQ

SEQ ID NO: 3941 - protein, 222 aa, Paenibacillus sp.
MKHLKHIGKTMKFAVLAAAIAGLTQTAGVADAASLHTAKEGDTFFLLAQRYGVSVDELTKANPNIASNNIYAGLQIKVPGEKRVKAASDSKPQLLTEKAPANEGPTIEAWGKTFNYSKIVDVKASAYSAAADENGKWGAVDYYGNPLKLGTIAVDPNVIPMGTKVLVTGYSHPGLPDHSFVAVARDQGSAITGKRIDIFIPGNKSFVNDFGFQNVKLYVIDK

SEQ ID NO: 3942 - protein, 222 aa, Paenibacillus sp.
MKHLKHIGKTMKFAVLAAAIAGLAQTAGVADAASLHTAKEGDTFFLLAQRYGVSVDGLTKANPNIASNNIYAGLQIKVPGEKSVKAASDSKPQLLTEKAPANEGPTIEAWGKTFNYSKIVDVKASAYSAAADENGKWGAVDYYGNPLKLGTIAVDPNVIPMGTKVLVTGYSHPGLPDHSFVAVARDQGSAITGKRIDIFISGNKSFVNDFGFQNVKLYVIDK

SEQ ID NO: 3943 - protein, 222 aa, Paenibacillus sp.
MKHLKHIGKTMKFAVLAAAIAGLAQTAGVADAASLHTAKDGDTFFLLAQRYGVSVDELTKANPNIASNNIYAGLQIKVPGEKSVNAASDSKPQLLTEKAPANEGPTIEAWGKTFNYSKIVDVKATAYSAAADENGKWGAVDYYGNPLKLGTIAVDPNVIPMGTKVLVTGYSHPGLPDHSFVAVARDQGSAITGKRIDIFIPGNKSFVNDFGFQNVKLYVIDK

SEQ ID NO: 3944 - protein, 222 aa, Paenibacillus sp.
MKHLKHIGKTMKIAVLAAAIAGLAQTAGIADAASLHTAKEGDTFFLLAQRYGVSVDELTKANPNIASSNIYAGLQIKVPGEKSVKAASESKPQLLTEKAAANEAPTIEAWGKTFNYSKIVDVKASAYSAAADENGKWGAVDYYGNPLKLGTIAVDPNVIPMGTKVLVTGYSHPGLPDHSFVAVARDQGSAITGKRIDIFIPGNKSFVNDFGFQNVKLYVIDK

SEQ ID NO: 3945 - protein, 222 aa, Paenibacillus sp.
MKHLKHIGKTMKFAVLAAAIAGLAQTAGVANAASLHTAKEGDTFFLLAQRYGVSVDDLTKANPDIASNNIYAGLQIKVPDEKSVKAASDSKPQLLTEKAPANERPTIEAWGKTFNYSKVVDVKATAYSAAADENGKWGAVDYYGNPLKLGTIAVDPKVIPMGTKVLVTGYSHPGLPDHSFVAVARDQGSAITGKRIDIFIPGNKSFVNDFGFQNVKLYVIDK

SEQ ID NO: 3946 - protein, 222 aa, Paenibacillus sp.
MKHLKHIGKTMKFAVLAAAIAGLAQTAGVANAASLHTAKEGDTFFLLAQRYGVSVDDLTKANPDIASNNIYAGLQIKVPDEKSVKAASDSKPQLLTEKAPANERPTIEAWGKTFNYSKVVDVKATAYSAAADENGKWGAVDYYGNPLKLGTIAVDPKFIPMGTKVLVTGYSHPGLPDHSFVAVARDQGSAITGKRIDIFIPGNKSFVNDFGFQNVKLYVIDK

SEQ ID NO: 3947 - protein, 222 aa, Paenibacillus sp.
MKRLKHIGKTMKFAVLAAAIAGLAQTAEVANAASLHTAKEGDTFFLLAQRYGVSVDDLTKANPDIASNNIYAGLQIKVPDEKSVKAASDSKPQLLTEKAPANERPTIEAWGKTFNYSKVVDVKATAYSAAADENGKWGAVDYYGNPLKLGTIAVDPKVIPMGTKVLVTGYSHPGLPDHSFVAVARDQGSAITGKRIDIFIPGNKSFVNDFGFQNVKLYVIDK

SEQ ID NO: 3948 - protein, 222 aa, Paenibacillus sp.
MKQLKHIGQAMKFAVLAAAIAGLAQTAGVADAASLHTAKEGDTFFLLAQRYGVSVDELTKANPNIAPSNIYAGLQIKVPGETSVKAASDSEPQLLKETAPANEGQTIEAWGKTFNYSKVVDVKATAYSAAADENGKWGAVDYYGNPLKLGTIAVDPNVIPMGTKVLVTGYSHPGLPDHSFVAVARDQGSAITGKRIDIFIPGNKSFVNDFGFQNVKLYVIDK

SEQ ID NO: 3949 - protein, 222 aa, Paenibacillus sp.
MKHLKRIGQTMKFAVLAAAIAGLAQTAGVANAASLHTAKEGDTFFLLAQRYGVSVDELTKANPNIAPSNIYAGLQIKVPGETSVKAASDSKPQLLKETGPANGGPTIEAWGKTFNYSKVVDVKATAYSAAADENGKWGAVDYYGNPLKLGTIAVDPNVIPMGTKVLVTGYSHPGLPDHSFVAVARDQGSAITGKRIDIFIPGSKLFVNDFGFQNVKLYVIDK

SEQ ID NO: 3950 - protein, 222 aa, Paenibacillus sp.
MKHLKRIGQTMKFAVLAAAIAGLAQTAGVANAASLHAAKEGDTFFLLAQRYGVSVDELTKANPNIAPGNIYAGLQIKVPGDTGVKAASDSKPQLLKETAPANEGPTIKAWGKTFNYSKVVDVKATAYSAAGDENGKWGAVDYYGNPLKLGTIAVDPNVIPMGTKVLVTGYSHPGLPDHSFVAVARDQGSAITGKRIDIFIPGSKSFVNDFGFQNVKLYVIAK

SEQ ID NO: 3951 - protein, 222 aa, Paenibacillus sp.
MKHLKRIGKTMKFAVLAAAIAGLAQTAGVADAASLHTAKEGDTFFLLAQRYGVSVEDLKKENPDVAASNIYAGVQIKVPDENKLKAASDSKPQLLSEKAPAGDGQQVEAWGKTFNYSKVVDVKATAYSAAASENGKWGAVDYFGNPLKLGTIAVDPNVIPLGTKVLVTGYSHPGLPDQSFVAVARDKGSAITGKRIDIFIPGSPSFVSDFGFQNVKLYVIDK

SEQ ID NO: 3952 - protein, 222 aa, Paenibacillus sp.
MKHLKRIGKTMKFAVLATAIAGLAQTAGVADAASLHTAKEGDTFFLLAQRYGVSVEDLQKENPDVAASNIYAGVQIKVPDDNKVKAASDSKPQLLSEKAPAGDGQQVEAWGKTFKYSKVVDVKATAYSAAASENGKWGAVDYFGNPLKLGTIAVDPNVIPLGTKVLVTGYSHPGLPDQSFVAVARDKGSAITGKRIDIFIPGSPSFVSDFGFQNVKLYVIDK

SEQ ID NO: 3953 - protein, 222 aa, Paenibacillus sp.
MKHLKHIGKTMKFAVLAAAFAGLAQTAGVADAASLHTAREGDTFFLLAQRYGVSVEDLQKENPDVAASNIYAGVQIKVPDENKVKVASDSKPQLLSEKEPAGDGQQVEAWGKTFSYSKVVDVKATAYSAAASENGKWGAVDYFGNPLKLGTIAVDPSVIPLGTKVLVTGYSHPGLPDQSFVAVARDKGSAITGKRIDIFIPGSPSFVSDFGFQNVKLYVIDK

SEQ ID NO: 3954 - protein, 282 aa, Curtobacterium sp.
MDQHIDRRRFMTLGLAGAATTALGATAIGADGSAQAATTSAAAPVLLAADEFDGPAGSAPNPGIWRYDLGAGGWGNAELQTYTDSRRNAALDGAGNLVITAHREADGSYSSARLKSESTYTAQYGRIEARIRIPRGQGIWPAFWMLGADIGQVGWPACGEIDVMENVGYEPGIVHGTVHGPGYSGAQGISAAYTAPSGAAFADDFHVYGVDWRPGSITWTVDGVAYRTVTRADVGSAPWVFDKPFFVILNVAVGGNWPGSPDASTRFPQQMTIDWLRVHQNA

SEQ ID NO: 3955 - protein, 282 aa, Curtobacterium sp.
MDQHIDRRRFMTLGLAGAATTALGATAIGADGSAQAATPSAAAPVLLAADEFDGPAGSAPNPGIWRYDLGAGGWGNAELQTYTDSRRNAALDGAGNLVITAHREADGSYSSARLKSESTYTAQYGRIEARIRIPRGQGIWPAFWMLGADIGQVGWPACGEIDVMENVGYEPGIVHGTVHGPGYSGAQGISAAYTGPSGAAFADDFHVYGVDWRPGSITWTVDGVAYRTVTRSDVGSAPWVFDKPFFVILNVAVGGNWPGSPDASTRFPQQMTIDWLRVHQNA

SEQ ID NO: 3956 - protein, 285 aa, Curtobacterium sp.
MDQHIDRRRFVSLGLAGAAATALGVTAIGADGSAQAATGAAAPTAEPVLLAADEFDGPAGSAPNPAVWRYDLGAGGWGNAELETYTDSRRNAALDGAGNLVITAQREADGSYTSARLKSEGASTAQFGRIEARIRIPRGQGIWPAFWMLGADIGQVGWPACGEIDVMENVGYEPGIVHGTVHGPGYSGAQGISASYTAPSGAAFADDFHVYGVDWRPGSITWTVDGVAYRTLTRADVGSNPWVFDKPFFVILNVAVGGTWPGSPDDSTQFPQQMTVDWLRVHQNA

SEQ ID NO: 3957 - protein, 283 aa, Curtobacterium sp.
MDQGPAFDRRRFVTLGLTGAAATAAAATSALLPGTATARAATAAGTLLAADEFDGAAGSAPNPGIWRFDLGAGGWGNGELETYTDSRRNSQLDGTGNLVITARREADGTYTSARLKSEGTYTAQYGRVEARIKIPRGQGIWPAFWMLGADIGQVGWPACGEIDVMENVGYEPALVHGTVHGPGYSGANGISATYRNPSGAAFADDFHVFGVDWRPDSITWTVDGTAYRTVTRADVGSNPWVFDGPFFVILNVAVGGGWPGSPDATTRFPQQMLVDWVRVSQLD

SEQ ID NO: 3958 - protein, 292 aa, unknown
  environmental sample
MLHDHTPTDAAHTVDRRRFLALGLGSAAATTAAVGAALTPDDHAAAATTTSSGGVLLAADEFDGAAGSAPNPGIWRFDTGAGGWGNAELQTYTDSRRNSALDGAGNLVITARREADGTYTSARLKTEGTFTAQYGRIEARIRIPRGQGIWPAFWMLGADIGQVGWPACGEIDVMENVGYEPGVVHGTVHGPGYSGAQGMSAAATLPNGAAWADAYHVFGVDWRPGSVTWLVDGVAQRTVTRADVGSSPWVFDKPFFVLLNVAVGGTWPGSPDATTRFPQQMFVDWVRVWQQA

SEQ ID NO: 3959 - protein, 298 aa, unknown
  environmental sample
MTNAPTPDHRTRPVLRDADGLDRRRFLTLGLTGAAVASTTAGAVLATGAGAQAATPSNGAVLLAADEFDGAAGSAPNPGIWRFDTGAGGWGNAELQTYTDSRRNSALDGAGNLVITARREADGSYTSARLTTEGTFTAQYGRVEARIRIPRGQGLWPAFWMLGADIGQVGWPACGEIDVMENVGYEPAVVHGTVHGPGYSGAQGLTASYTQPGGAAFADDFHVFGVDWRPGSITWTVDGVARRTVTRADVGTSPWVFDKPFFVVLNVAVGGTWPGSPDATTRFPQQMLVDWVRVWQQA

SEQ ID NO: 3960 - protein, 291 aa, unknown
  environmental sample
MQHDDQQQTDHPDDGAVGIDRRRLLTLGLGAAAALGAAGVAGLRPEAAHAATGPTLLAADEFDGPAGSAPNPDIWRYELGGGGWGNGELEVYTDSRRNSALDGDGNLVITARREADGSYTSARLTSQGTYSAQYGWIEARIRIPRGQGIWPAFWMLGADLPQVGWPACGEIDVMENIGREPAAVHGTVHGPGYSGAEGVSGTATLPSGAFADDFHVYGVDWRPGSISWTVDGATYRTVTPADLGGDRWVFDKPFFVVLNVAVGGGWPGSPDSSTQFPQQMTVDWLRVWQNA

SEQ ID NO: 3961 - protein, 657 aa, unknown
  environmental sample
MKPLHAQYLFCCATLSLLSPLPAMAWSDLTVFGDSLSDGGNVGRFTYDGATHPLYDEIVAQSLGDNLRPSSQGGNNYAEGGAVAVPAINPLFNTQDQLDNYLAARGGRADPDGLYIHWIGGNDLAAAALAPLAARQIVDNSASAAASQVSRLLDAGAGTVIVPTVPNVGATPALLQAILQVLGPAAQPATAALFQSLSTTTTPDRAAREQAIETALGEAAGQISSIPLIRDAIAQQLIAAWKLLSQEAATLTDRYNQAEEQGLVAARGNIARVDINGLFNEVIDNPGLYGLTNTAGMACPPGVSAMDCTSSTTGFSQSQQYLFADRLHPSPAVHALIADYIQSVLNAPLQVAALSRAPSMLVGDAHNTLDGHLQQQRQQPANAGEFTVFGGYAGQQRDFRGDSLQDGDATSASGTVGVGYQLTDHWQAGAMLSTTSQRQDPSSRFDYRLRGNLVALWSQLNYLDRGWINADAHYADLDFDDIERQIRLGPATRTEKGNSNGKVLGMRLQTGWDLPLGSYVSTGPVASYALDYTQVDGYKEEGNSSTSMRFGDQTLHSQIGAVGWRIDSKDLLINPWAQVSYNHQFGDSDSAVTAGLKSTRTAFTRSSDASDDNWIDMAVGASVPLGTSVNAFAGVSAVTGNSDMHQVTWNVGLNARF

SEQ ID NO: 3962 - protein, 657 aa, unknown
  environmental sample
MKPLHAQYLFCCATLSLLSPLPAMAWSDLTVFGDSLSDGGNVGRFTYDGATHPLYDEIVAQSLGDNLRPSSQGGSNYAEGGAVAVPAINPLFNTQDQLDNYLAARGGRADSDGLYIHWIGGNDLAAAALAPLAARQIVDNSASAAASQVSRLLDAGAGTVIVPTVPNVGATPALLQAILQVPGPAAQPATAALFQSLSTTTTPDRAAREQAIETALGEAAGQISSIPLIRDAIAQQLIAAWELLSQEAAALTDRYNQAEEQGLVAARGNIARVDINGLFNEVIANPGLYGLTNTAGMACPPGVSAMDCTSSTTGFSQSQQYLFADRLHPSPAVHALIADYIQSVLNAPLQVAALSRAPSMLVGDAHNTLDGHLQQQRQQPANAGEFTVFGGYAGQQRDFRGDSLQDGDATSASGTVGVGYQLTDHWQAGAMLSTTSQRQDPSSRFDYRLRGNLVALWSQLNYLDRGWINADAHYADLDFDDIERQIRLGPATRTEKGNSNGKVLGMRLQTGWDLPLGSYVSTGPVASYALDYTQVDGYKEEGNSSTSMRFGDQTLHSQIGAVGWRIDSKDLLINPWAQVSYNHQFGDSDSAVTAGLKSTRTAFTRSSDASDDNWIDMAVGASVPLGTSVNAFAGVSAVTGNSDMHQVTWNVGLNARF

SEQ ID NO: 3963 - protein, 657 aa, unknown
  environmental sample
MKPLHAQYLFCCATLSLLSPLPAMAWSDLTVFGDSLSDGGNVGRFTYDGATHPLYDEIVAQSLGDNLRPSSQGGNNYAEGGAVAVPAINPLFNTQDQLDNYLAARGGRADPDGLYIHWIGGNDLAAAALAPLAARQIVDNSASAAASQVSRLLDAGAGTVIVPTVPNVGATPALLQAILQVLGPAAQPATAALFQSLSTTTTPDRAAREQAIETALGEAAGQISSIPLIRDAIAQQLIAAWKLLSQEAATLTDRYNQAEEQGLVAARGNIARVDINGLFNEVIANPGLYGLTNTAGMACPPGVSAMDCTSSTTGFSQSQQYLFADRLHPSPAVHALIADYIQSVLNAPLQVAALSRAPSMLVGDAHNTLDGHLQQQRQQPANAGEFTVFGGYAGQQRDFRGDSLQDGDATSASGTVGVGYQLTDHWQAGAMLSTTSQRQDPSSRFDYRLRGNLVALWSQLNYLDRGWINADAHYADLDFDDIERQIRLGPATRTEKGNSNGKVLGMRLQTGWDLPLGSYVSTGPVASYALDYTQVDGYKEEGNSSTSMRFGDQTLHSQIGAVGWRIDSKDLLINPWAQVSYNHQFGDSDSAVTAGLKSTRTAFNRSSDASDDNWIDMAVGASVPLGTSVNAFAGVSAVTGNSDRHQVTWNVGLNARF

SEQ ID NO: 3964 - protein, 657 aa, Pantoea sp.
MKPLHAQYLFCCATLSLLSPLPAMAWSDLTVFGDSLSDGGNVGRFTYDGATHPLYDEIVAQSLGDNLRPSSQGGNNYAEGGAVAVPAINPLFNTQDQLDSYLAARGGRADSDGLYIHWIGGNDLAAAALAPLAARQIVDNSASAAASQVSRLLDAGAGTVIVPTVPNVGATPALLQAILQVLGPAAQPATAALFQSLSTTTTPDRAAREQAIETALGEAAGQISSIPLIRDAIAQQLIAAWQLLSQEAATLTDRYNQAEEQGLVTARGNIARVDINGLFNEVIDNPGLYGLTNTAGMACPPGVSAMDCTSSTTGFSQSQQYLFADRLHPSPAVHALIADYIQSVLNAPLQVAALSRAPSMLVGDAHNTLDGHLQQQRQQSANAGEFTVFGGYAGQQRDFRGDSLQDGDATSASGTVGVGYQLTDHWQAGAMLSTTSQRQDPSSRFDYRLRGNLVALWSQLNYLDRGWINADAHYADLDFDDIERQIRLGPATRTEKGNSNGKVLGMRLQTGWDLPLGSYVSTGPVASYALDYTQVDGYKEEGNSSTSMRFGDQTLHSQIGAVGWRIDSKDLLINPWAQVSYNHQFGDSDSAVTAGLKSTRTAFTRSSDSSDDNWIDMAVGASVPLGTSVNAFAGVSAVTGNSDMHQVTWNVGLNARF

SEQ ID NO: 3965 - protein, 657 aa, unknown
  environmental sample
MKPLHAQYLFCCATLSLLSPLPAMAWSDLTVFGDSLSDGGNVGRFTYDGATHPLYDEIVAQSLGDNLRPSSQGGSNYAEGGAVAVPAINPLFNTQDQLDSYLAARGGRADSDGLYIHWIGGNDLAAAALAPLAARQIVDNSASAAASQVSRLLDAGAGTVIVPTVPNVGATPALLQAILQVPGPAAQPATAALFQSLSTTTTPDRAAREQAIETALGEAAGQISSIPLIRDAIAQQLIAAWQLLSQEAAALTDRYNQAEEQGLVTARGNIARVDINGLFNEVIDNPGLYGLTNTAGMACPPGVSAMDCTSSTTGFSQSQQYLFADRLHPSPAVHALIADYIQSVLNAPLQVAALSQAPSMLVGDARNTLDGHLQQQRQQPASAGEFTVFGGYAGQQRDFRGDSLQDGDATSASGTVGVGYQLTDHWQAGAMLSTTSQRQDPSSRFDYRLRGNLVALWSQLNYLDRGWINADAHYADLDFDDIERQIRLGPATRTEKGNSNGKVLGMRLQTGWDLPLGSYVSTGPVASYALDYTQVDGYKEEGNSSTSMRFGDQTLHSQIGAVGWRIDSKDLLINPWAQVSYNHQFGDSDSAVTAGLKSTRTAFTRSSDSSDDNWIDMAVGASVPLGTSVNAFAGVSAVTGNSDMHQVTWNVGLNARF

SEQ ID NO: 3966 - protein, 657 aa, unknown
  environmental sample
MKPLHAQYLFCCATLSLLSPLPAMAWSDLTIFGDSLSDGGNVGRFTYDGATHPLYDEIVAQSLGDNLRPSSQGGSNYAEGGAVAVPAINPLFNTQDQLDSYLAARGGRADSDGLYIHWIGGNDLAAAALAPLAARQIVDNSASAAASQVSRLLDAGAGTVIVPTVPNVGATPALLQAILQVLGPAAQPATAALFQSLSTTTTPDRAAREQAIETALGEAAGQISSIPLIRDAIAQQLIAAWQLLSQEAATLTDRYNQAEEQGLVTARGNIARVDINGLFNEVIDNPGLYGLTNTAGMACPPGVSAMDCTSSTTGFSQSQQYLFADRLHPSPAVHALIADYIQSVLNAPLQVAALSRAPSMLVGDAHNTLDGHLQQQRQQSASAGEFTVFGGYAGQQRDFRGDSLQDGDATSASGTVGVGYQLTDHWQAGAMLSTTSQRQDPSSRFDYRLRGNLVALWSQLNYLDRGWINADAHYADLDFDDIERQIRLGPATRTEKGNSNGKVLGMRLQTGWDLPLGSYVSTGPVASYALDYTQVDGYKEEGNSSTSMRFGDQTLHSQIGAVGWRIDSKDLLINPWAQVSYNHQFGDSDSAVTAGLKSTRTAFTRSSDSSDDNWIDMAVGASVPLGTSVNAFAGVSAVTGNSNMHQVTWNVGLNARF

SEQ ID NO: 3967 - protein, 657 aa, Pantoea sp.
MKPLHAQYLFCCATLSLLSPLPAAAWSDLTVFGDSLSDGGNVGRFTYDGATHPLYDEILAQSLGDTLRPSSLGGNNYAEGGAVAVPAINPLFNTQDQLDSYLAARGGRADPNGLYIHWIGGNDLAAAALAPLAAQQIVDNSASAAASQVSRLLNAGAGTVIVPTVPNVGATPALLQAILQVLGPAAQPATAALFQSLSTTTTPDRAAREQAIETALNEAAGQVSSIPLIRDALAQQLIAAWQLLSQEAATLTDRYNQAEEQGLLTARGNIARVDINGLFNEVIDNPRLYGLSNTAGMACPPGVSSMDCTSSTPGFSQSQQYLFADRLHPSPAVHALIADYIKSVLNAPLQVAALAQAPSMLVGDAHNTLDGHLQQQRQQPASAGEFTVFGGYAGQQRDFRGDSLLDGDATSATGTVGVGYQLTDHWQAGAMLSATSQRQDPSSRFDYRLRGNLVALWSQFNYLDGGWINADAHYADLNFDDIERQIRLGPATRTEKGSSDGKVLGMRVQTGWDLPLGRYVSTGPMASYALDYTQVDGYKEEGNSSTSMRFGDQTLHSQIGSVGWRIDSKDLLINPWAQVSYNHQFGDTDSAVTAGLKSTRTAFTRNSGSRDDNWIDMAVGASVPIGASVNAFAGVSAVAGNSDTHQVTWNVGLNARF

SEQ ID NO: 3968 - protein, 657 aa, Pantoea sp.
MKPLHAQYLFCCATLSLLSPLPAMAWSDLNVFGDSLSDGGNVGRFTYDGATHPLYDEILAQSLGDILRPSSQGGNNYAEGGAVAVPAINPLFNTQDQLDRYLAARDGRADPDGLYIHWIGGNDLAAAALAPLAAQQIVDNSASAAASQVSRLLDAGAGTVIVPTVPNVGATPALLQAILQVLGPAAQPATAALFQSLSATTTPDRAAREQAIETALNEAAGQVSSIPLIRDALAQQLIAAWQLLSQEAAALTDRYNQAEEQGLVAARGNIARVDMNGLFNEVIDNPRLYGLSNTAGMACPPGVSSMDCTSSTPGFSQSQQYLFADRLHPSPAVHALIADYIQSVLNAPLQVAALSQAASMLVGDVQNTLDGHLQQQRQQPASAGEFTVFGGYAGQQRDFRSDSLLDGDATSATGTVGVGYQLTDHWQAGAMLSTTSQRQDPSSRFDYRLRGNLVALWSQLNYLDRGWINADAHYADLNFDDIERKVRLGPATRTEKGSSDGKVLGMRVQTGWDLPLGRYVSTGPMASYALDYTQVDGYREEGNSSTSMRFGDQTLHSQIGSVGWRIDSKDLVINPWAQVSYNHQFGDSDSAVTAGLKSTRTAFTRSSGSRDDSWINMALGASVPIGTSVNAFAGVSAVTGNSDYHQVTWNVGLNARF

SEQ ID NO: 3969 - protein, 657 aa, unknown
  environmental sample
MKPLHAQYLFCCATLSLLSPLPAMAWSDLTVFGDSLSDGGNVGRFTYDGATHPLYDEIVAQSLGDTLRPSSQGGSNYAEGGAVAVPAINPMFNTQDQLDNYLATRDGRADSDGLYIHWIGGNDLAAAALAPLAAQQIVDNSASAAASQVSRLLDAGAGTVIVPTVPNVGATPALLQAILQVLGPAAQPATAALFQSLSTTATPDRAAREQAIETALNEAAGQVTSIPLIRDALAQQLFAAWQLLSQEAAALTDRYNQAEEQGLVAARGNIARVDINGLFNEVIDNPRLYGLSNTAGMACPPGVSSMDCTASTPGFSQSQQYLFADRLHPSPAVHALIADYIESVLSAPLQVAVLSQAPSMLVGDAQNTLDGHLQQQRQQPASAGEFTVFGGYAGQQRDFRGDSLLDGDATSATGTVGVGYQLSDHWQAGAMLSTTSQRQDPSQRFDYRLRGNLVALWSQVNYLDRGWINADAHYADLNFDDIERKVRLGPATRTEKGSSDGKVLGMRVQTGWDLPLGRYVSTGPMASYALDYTQIDGYREEGNSSTSMRFGDQTLHSQIGSVGWRIDSKDLVINPWAQVSYNHQFGDSDSAVTAGLKSTRTAFTRSSGSRDDNWINMALGASVPIGTSVNAFAGVSAVTGNSDYHQVTWNVGLNARF

SEQ ID NO: 3970 - protein, 657 aa, unknown
  environmental sample
MKPLHAQYLFCCATLSLLSPLPAMAWSDLTVFGDSLSDGGNVGRFTYDGATHPLYDEIVAQSLGDTLRPSSQGGSNYAEGGAVAVPAINPMFNTQDQLDNYLATRDGRADSDGLYIHWIGGNDLAAAALAPLAAQQIVDNSASAAASQVSRLLDAGAGTVIVPTVPNVGATPALLQAILQVLGPAAQPATAALFQSLSTTATPDRAAREQAIETALNEAAGQVTSIPLIRDALAQQLFAAWQLLSQEAAALTDRYNQAEEQGLVAARGNIARVDINGLFNEVIDNPRLYGLSNTAGMACPPGVSSMDCTASTPGFSQSQQYLFADRLHPSPAVHALIADYIESVLSAPLQVAVLSQAPSMLVGDAQNTLDGHLQQQRQQPASAGEFTVFGGYAGQQRDFRGDSLLDGDATSATGTVGVGYQLSDSWQAGAMLSTTSQRQDPSSRFDYRLRGNLVALWSQLNYLDRGWINADAHYADLNFDDIERKVRLGPATRTEKGSSDGKVLGMRVQTGWDLPLGRYVSTGPMASYALDYTQIDGYREEGNSSTSMRFGDQTLHSQIGSVGWRIDSKDLVINPWAQVSYNHQFGDSDSAVTAGLKSTRTAFTRSSGSRDDNWINMALGASVPIGTSVNAFAGVSSVTGNSDHHQVTWNVGLNARF

SEQ ID NO: 3971 - protein, 657 aa, unknown
  environmental sample
MKPLHAQTLFCCAILSLLSPLPAAAWSHLTVFGDSLSDGGNVGRFTYDGATHPLYDEIVAQSLGDTLRPSSQGGNNYAEGGAVAVPVINPLFNTQDQLQSYLTSRGGRADPDGLYIHWIGGNDLAAAALSPLTARPLVDNSAGAAALQVSRLLDAGAGTVIVPTVPNVGATPALLQAILQTLGPAAQPATAALFQSLSTRTTPDRAAREQAIETALGEAAGQLSAIPPIREALAQQLIAAWRLLSEAASALTDRYNQAEEEGLLAARGNIARVDINGLFNEVIDNPGRYGLTNTAGMACPPGVSSMDCTTSTPGFSSSQQYLFADRLHPSPAVHALIADYIQSVLNAPLQVAALSRAPSMLVGDAQNTLDGHLQQQRQQPAEAGTLTVFGGYAGQQRDFRGDSLLDGDATSATGTVGVGYQLTDAWQAGAMLSTTSQRQQPSSRFDYRLRGNLVAIWSQLNYLDHGWINADAHYADLDFDDIKRQVKLGPATRTEQGNSGGKVLGMRVQTGWDLPVGRYVTTGPVASYALDYTRVGGYQEEGNSSTSMRFGDQTLHAQVGSLGWRIDSKDLPVNPWAQISYNHQFGDSDSAVTAGLKSTRTAFTRSSDGRDDNWINMAVGASVPLGAAVNAFAGVSAVAGNSETHQVTWNVGVNARF

SEQ ID NO: 3972 - protein, 657 aa, Pantoea sp.
MKPLHAQTLFCCAILSLLSPLPAAAWSHLTVFGDSLSDGGNVGRFTYDGATHPLYDEIVAQSLGDTLRPSSQGGNNYAEGGAVAVPAINPLFNTQDQLQSYLASRGGRADPDGLYIHWIGGNDLAAAALSPLIARQLVDNSAGAAALQVGRLLDAGAGTVIVPTVPNVGATPALLQAILQTLGPAAQPATAALFQSLSTRTTPDRAAREQAIETALGEAAGQLSAIPPIREALAQQLIAAWRLLSEAASALTDRYNQAEEEGLLAARGNIARVDINGLFNEVIDNPFRYGLTNTAGMACPPGVSSMDCTASTPGFSSSQQYLFADRLHPSPAVHALIADYIQSVLNAPLQVAALSRAPSMLVGDAQNTLDGHLQQQRQQPAEAGTLTVFGGYAGQQRDFRGDSLLDGDATSATGTVGVGYQLTDAWQAGAMLSTTSQRQQPSSRFDYRLRGNLVAIWSQLNYLDHGWINADAHYADLDFDDIKRQVKLGPATRTEQGNSGGKVLGMRVQTGWDLPVSRYVTTGPVASYALDYTRVGGYQEEGNSSTSMRFGDQTLHAQVGSLGWRIDSKDLPVNPWAQISYNHQFGNSDSAVTAGLKSTRTAFTRSSDGTDDNWINMAVGASVPLGAAVNAFAGVSAVAGNSETHQVTWNVGVNARF

SEQ ID NO: 3973 - protein, 586 aa, Pantoea sp.
QGGNNYAEGGAVAVPAINPLFNTQDQLDNYLAARGGRADPDGLYIHWIGGNDLAAAALAPLAARQIVDNSASAAASQVSRLLDAGAGTVIVPTVPNVGATPALLQAILQVLGPAAQPATAALFQSLSTTTTPDRAAREQAIENALGEAAGQISSIPLIRDAIAQQLIAAWKLLSQEAATLTDRYNQAEEQGLVAARGNIARVDINGLFNEVIANPGLYGLTNTAGMACPPGVSAMDCTSSTTGFSQSQQYLFADRLHPSPAVHALIADYIQSVLNAPLQVAALSRAPSMLVGDAHNTLDGHLQQQRQQPANAGEFTVFGGYAGQQRDFRGDSLQDGDATSASGTVGVGYQLTDHWQAGAMLSTTSQRQDPSSRFDYRLRGNLVALWSQLNYLDRGWINADAHYADLDFDDIERQIRLGPATRTEKGNSNGKVLGMRLQTGWDLPLGSYVSTGPVASYALDYTQVDGYKEEGNSSTSMRFGDQTLHSQIGAVGWRIDSKDLLINPWAQVSYNHQFGDSDSAVTAGLKSTRTAFTRSSDASDDNWIDMAVGASVPLGTSVNAFAGVSAVTGNSDMHQVTWNVGLNARF

SEQ ID NO: 3974 - protein, 660 aa, unknown
  environmental sample
MKSFHARHLLAGAAMTSLGMLSPLPAAAWSQLTVFGDSLSDGGNVGRFTYDAASHPLYDERVAQHLNETLLPSSQGGSNYAAGGAVVVPLLNPQFNTQDQVDRYLTANGGRADGNGLYIHWIGGNDLAAAAANPLNAVQLIDNSARAASDQVSRLLAAGAGTVIVPTVPDVGATPALLQAILQPLGPVAEPAMAALFQSLSTVTTPDRAAREQAIETALQAAADQIPAIPLVREAIAQQLFAAWQLLSDTAATLTDRYNQLEEQGLVASGGNIARVDINGLFSEVIDNPGLYGISNSAGMACPPGVSAMDCTSSTPGFSQAQQYLFADRLHPSPAVHALIADYIESILDAPLHVAALNQSPLMLVRDARNTLDGHLQQQRQQPADAGQFTVFGGYAGQSRDFRGDSDAEGDATSANGAIGIGYQLTDSWQAGAMFSATTQRQDPSSRFDYRLRGNLVALWSQLRLFDQGWINADLHYADLDFDDIERQVRLGPATRTEQGSTEGKLLGMRIETGWDLPLGQYVSTGPVASYALDYSQVDGYREQGNRSSAMRFGDQTLHSQVGSVGWRIDSRQLLINPWAQVSYNHQFGDSDSAVTAGLKSTRTAFTRTSDSGDDNWLDMAVGASVPLGSAVNAFAGVSAVAGNSQYHQVTWNIGLNARF

SEQ ID NO: 3975 - protein, 657 aa, Pantoea sp.
FHARHLLAGAAMTSLGMLSPLPAAAWSQLTVFGDSLSDGGNVGRFTYDAASHPLYDERVAQHLNETLLPSSQGGSNYAAGGAVAVPLLNPQFNTQDQVDRYLTANGGRADGNGLYIHWIGGNDLAAAAANPLNAVQLIDNSARAASDQVSRLLAAGAGTVIVPTVPDVGATPALLQAILQPLGPVAEPAMAALFQSLSTVTTPDRAAREQAIETALHAAADQIPAIPLVREAIAQQLFAAWQLLSDTAATLTDRYNQLEEQGLVASGGNIARVDINGLFSEVIDNPGLYGISNSAGMACPPGVSAMDCTSSTPGFSQAQQYLFADRLHPSPAVHALIADYIESILDAPLQVAALNQSPLMLVRDARNTLDGHLQQQRRQPADAGQFTVFGGYAGQSRDFRGDSDAEGDATSANGAIGIGYQLTDSWQAGAMFSATTQRQDPSSRFDYRLRGNLVALWSQLRLFDQGWINADLHYADLDFDDIERQVRLGPATRTEQGSTEGKLLGMRIETGWDLPLGQYVSTGPVASYALDYSQVDGYREQGNRSSAMRFGDQTLHSQVGSVGWRIDSRQLLINPWAQVSYNHQFGDSDSAVTAGLKSTRTAFTRTSDSGDDNWLDMAVGASVPLGSAVNAFAGVSAVAGNTQYHQVTWNIGLNARF

SEQ ID NO: 3976 - protein, 660 aa, Pantoea sp.
MKSFHARHLLSSAAITTLSLLSPLPAAAWSQLTVFGDSLSDGGNVGRFTYDAASHPLYDEILAQQLNQTLLPSSQGGSNYAAGGAVAVPALNPQYNSQDQLDRYLAASGGRADGNGLYIHWIGGNDLAAAAADPLNAVQVIDHSARSAADQVSRLLAAGAGTVVVPTVPNVGATPALLQAILQPLGPVAEPAMAALFQSLSSVTTPDRAAREQAIEAAFRQAADQIPAIPLVREAIARQLFAAWQLLSDTAATLTDRYNQLEEQGLVATGGNIARVDINRLFNEVIDNPVQYGISNSAGMACPPGVSAMDCTSATPGFSQAQQYLFADRLHPSPAVHALIADYIQSVLDAPLQVAALSQSPLMLVKDARSTLEGHLQQQRQQPAEAGQFTVFGGYAGLSRNFRGDSYQDGDATTANGAVGIGYQLNDSWQAGAMFSATSQRQEPSSRYDYRLRGNLVALWSQLRLFDQGWINADLHYADLDFDDIERQVRLGPATRTEQGSTDGKLLGMRIETGWDLPLGQYVSTGPVASYALDYSRVSGYQEQGNRSSAMRFGDQTLHSQVGSVGWRIDSRQLLINPWAQISYNHQFGDSDSAVTAGLKSTRTAFTRTSETGDDNWLDMAVGASVPLGTAVTAFAGVSAVAGNSEYHQVSWNVGLNARF

SEQ ID NO: 3977 - protein, 342 aa, Curtobacterium sp.
MAAVGLVVAGVAAPGSVQPASAAPMWPVPQPYPVPDDPAESLADLPPGSEYVALGDSYSAGYGLGDRTRLPTSACVQSARDYPHRLAARFGLDLTDVTCAGATSEDVTTGHQFNGVPPQIESLSSRTRLVTLTIGGNDADLFGTAASCLAISADGPVFSGRAAPSCESTLVQDGEDQLSAKIQSRVALGIADTLAAVKRAAPNAVVVFLGYPAIFPDTEHTPAKGCFRSALDLGTLAGSFPSDTFPFTDDDVAYLHGVQEELDTVSASAADAAGVRFVDVLDRTEAHSACAPADERYVAGVSLTGSSDLRRIDLQAGALHPNGRGVAYLTDQMADAIRELAG

SEQ ID NO: 3978 - protein, 318 aa, unknown
  environmental sample
MWPVPQPYPVPDDPTESLVDLPPGSEYVALGDSYSAGYGLGDRTRLPTSACVQSARDYPHRLAARFGLDLTDVTCAGATSEDVTTGHQFTGVPPQIESLSSRTRLVTLTIGGNDADLFGTAASCLAISADGPVFSGRDAPSCESTLVQDGEDQLSVKIQSRVALGIADTLAAVQRAAPNAVVVFLGYPAILPDAEHTPAKGCFRSALDLGTLAGSFPSDTFPFTDDDVAYLHGVQEELDAVSASASDAAGVRFVDVLERTEAHSACAPADERYVAGVSLTGSSDLRRIDLKAGALHPNGRGVAYLTDQMADAIRELAG

SEQ ID NO: 3979 - protein, 318 aa, Curtobacterium sp.
MWPVPQPYPVPDDPTEPLADLPPGSEYVALGDSYSAGYGLGDRTRLPTSACVQSARDYPHRLAARFGLDLTDVTCAGATSEDVTTGHQFTGVPPQIESLSSRTRLVTLTIGGNDADLFGTAASCLAISADGPVFSGRDAPSCKSTLVQDGEDQLSVKIRSRVALGIADTLAAVQRAAPNAVVVFLGYPAIFPDAEHTPAKGCFRSALDLGTLAGSFPSDTFPFTDDDVAYLHGVQEELDAVSASAADAAGVRFIDVLERTEAHSACAPRDERYVAGVSLTGSTDLRRIDLRAGALHPNGRGVAYLTDQMADAIRELAG

SEQ ID NO: 3980 - protein, 318 aa, Curtobacterium sp.
MWPVPQPYPVPGDPAEPLAEIPPGSEYVALGDSYSAGYGLGDRTRLPTSACVQSARDYPHRLAARFGLDLTDVTCAGATSEDVTTGHQFTGVPPQIESLSARTRLVTLTIGGNDADLFGTAASCLAISADGPVFSGRDAPSCESTLVRDGEDQLSVKIQSRVALGIADTLAAVQRAAPNAVVVFLGYPAIFPDAEHTPAKGCFRSALDLGTLAGSFPSDTFPFTDDDVAYLHGVQEELDAVSASAADAAGVRFVDVLERTEAHSACAPRDERYVAGVSLTGSSDLRRIDLKAGALHPNGRGVAYLTDQMADAIRELAG

SEQ ID NO: 3981 - protein, 345 aa, unknown
  environmental sample
MLAVLAAVVVAPWGPVAVAPTDGAVAAPMWPVPEPYPVTDDPAETLADLPPGSEYVALGDSYSAGYGLGDPTRLPTSACAQSARDYPHRLAARFGLDLTDVTCAGATSRDVVSGYQFRGVPPQVRALSEDTRLVTLTIGGNDADLFGTAASCLALSSRGPVFSGRDAPSCRSTLVHDGVDDLDVRIRSRVALGIADTLAAVRRAAPNAVVVFLGYPAIFPDAAHTPARGCFRSALDLGSLVGSFPRDTYPFTDGDVRYLHGVQESLDEVSASAAEAAGVPFVDVFARSQAHSACATDDPYVAGVSLSGAGDLSRIDMVPGALHPNGRGVAWLTGQVASELRRLED

SEQ ID NO: 3982 - protein, 351 aa, unknown
  environmental sample
MLAVAAAAVVGPWGVVTGPWSAPGGAGGDAVAAPMWPVPEPYPVTDDPAETLADLPPGSEYVALGDSYSAGYGLPDPTRLPTNACGQSARDYPHRIAARFGLDLTDVSCAGATSRDVVSGHQFRGVPPQVRALSERTRLVTLTIGGNDADLFGTAASCLALSSRGPVFSGRDAPSCRSTLVHDGVDDLELRIRSRVALGIADTLAAVRRAAPDAEVVLLGYPAIFPDAAHTPERGCFRSALDLGSLAGSFPRDTYPFTNTDVRYLHGVQEALDEVSAAAAAAAGVTFVDVFADSQAHSACATARPYVAGVSLSGTGDLSRIDLEPGALHPNERGVAWLTGRLAATLRGTAG

SEQ ID NO: 3983 - protein, 345 aa, unknown
  environmental sample
MLAVLAAAVVAPWGPVVGASTDGAVAAPMWPVPAPYPVTGDPVETLADLPPGSEYVALGDSYSAGYGLSDPTHLPTSACGQSARDYPHRLAARFGFALTDVTCAGATSRDVVSGYQFRGVPPQVRALSEDTRLVTLTIGGNDADLFGTAASCLALSSRGPVFSGRDAPSCRSTLVHDGVDDLEVRIRSRVALGIADTLAAVRQAAPNAVVVFLGYPAIFPDAAHTPAKGCFRSALDLGSLVGSFPRDTYPFTNSDVRYLHGIQESLDEVSASAAEAAGVPFVDVFAESQAHSACATDRPYVSGVSLSGTGDLSSIDMEPGALHPNGRGVAWLTRQLAAELRTLAG

SEQ ID NO: 3984 - protein, 484 aa, Pseudomonas sp.
MSSPIRKAINSDALTRLAQAIAVAVSATLAGCSSHVPQTEATHTPNIAARAKQKPIWLSEKPTPQVPQDVWERMRQGFQLQDNLGVNPRIEQQRLWFASNPSFLENAGERGSLYIHYIVERLEERNMPLELALLPVIESAYNPMAYSRADAVGLWQFIPSTGRYFNLRQTRFYDGRRDITASTTAAMDYLTRLHDMFNGDWLLALAAYNAGEGTVSRAIERNEKLGLPTDYWNLPLPAETQAYVPKLLALSQVVLAPDAYGVNLKSIANEPYFQVVEINQRMDLSKVAAVANIDEDELFQLNPAFKQRTTIDGPQHLLVPTSKAQLLTASLSTMRPEELISQRPLKPVFEGADDSEIASIKRAYRVKRGENLASIARANKVDVKDLQRWNKLNGKNLKVGQTLVMQDTSKRSGGRINTVVAANSKTSGKSDKQKPQTQYKVQQGDSLYMVAKRFNVEMQHLKRWNPRVGQALKPGQMLTVSSPH

SEQ ID NO: 3985 - protein, 484 aa, Pseudomonas sp.
MSSPIRKAINSDALTRLAQVIAVAVSATLAGCSSHVPQTEATHTPNIAARAKQKPVWLSEKPTPQIPQDVWERMRQGFQLQDNLGVNPRIEQQRLWFASNPSFLENAGERGSLYIHYIVERLEERNMPLELALLPVIESAYNPMAYSRADAVGLWQFIPSTGRYFNLRQTRFYDGRRDITASTTAAMDYLSRLHDMFNGDWLLALAAYNAGEGTVSRAIERNERLGLPTDYWNLPLPAETQAYVPKLLALSQVVLAPDAYGVNLNPIANEPYFQVVEINQRMDLSKVAAVANIDEDELFQLNPAFKQRTTIDGPQHLLVPTSKAQLLTASLSTMRPEELISQRSLKPVFEGADDSEIASLKRAYRVKRGDNLGTIAKANKVEVKDLQRWNKLNGKDLKVGQTLVMQDTTKRKSGRINTVVAVNSKTNGKATNKTQQTQYKVKQGDSLYMVAKRFNVEMQHLKRWNPRVGQALKPGQMLTVASPH

SEQ ID NO: 3986 - protein, 485 aa, Pseudomonas sp.
MSSSIRKAINSDALTRLAQAIAVAVSATLAGCSSHVPQTDAAHTPNIAARAKQKPIWLSEKPSPQIPQDVWERMRQGFQLQEGLGVNPRIEQQRLWFASNPSFLENAGERGSLYIHYIVERLEERNMPLELALLPVIESAYNPMAYSRADAVGLWQFIPSTGRYFNLRQTRFYDGRRDITASTTAAMDYLTRLHDMFNGDWLLALAAYNAGEGTVSRAIERNERLGLPTDYWNLPLPSETQAYVPKLLALSQVVLAPEAYGVNLNPIANEPYFQAVEINQRMDLSKVAAVANIDEDELFQLNPAFKQRTTTLDGPQHLLVPTSKAQLLTASLSTMRPEELISKKSLKPVFEGADDTQIASLKRAYRVKRGDNLGTIAKANKVDVKDLQRWNKLTGKDLKVGQTLVMQDKTKRSSGRVNTVVAANTKTNGKTDTKKPQTQYKVQQGDSLYIVAKRFNVEMQHLKRWNPRVGQALKPGQMLTVASPH

SEQ ID NO: 3987 - protein, 483 aa, Pseudomonas sp.
MSSSIRKSIHSDALTRLAQAIAVAVSATLAGCSSHVPQTEVTHTPNIAARAKQKPIWLTEKPVPQIPQDVWERMRQGFQLQDNVGVNPRVEQQRLWFASNPSYLESAGERGSLYIHYIVERLEERNMPLELALLPVIESSYNPMAYSRAHAVGLWQFIPSTGRYFNLRQTRFYDGRRDITASTTAAMDYLTRLHDMFNGDWLLALAAYNAGEGTVSRAIERNEKLGLPTDYWNLPLPAETQAYVPKLLALSQVVLAPEAYGVNLSPIANEPYFQVVEINQRMDLSKVAAVANIDEDELFQLNPAFKQRTTIDGPQHLLVPTSKAQLLTASLSTMRPDELISQKPLKPVFEGVDRNEIASLKRAYRVKRGDNLGTIAKANKVDVKDLQRWNKTSGKNLKVGQTLVMQDTSKRGSGRVNTVVAANSKSAGKSSKKAQTQYKVKQGDSLYMVAKRFNVEMQHLKRWNPRVGQALKPGQMLTVSSPH

SEQ ID NO: 3988 - protein, 487 aa, Pseudomonas sp.
MSSSIRKSVNSDALTRLAQAIAVAVSATLAGCSSHAPQTEATHTPNIAARAKQKPIWLTEKPTPVAPQDIWERMRQGFQLQEGLGVNPRIEQQRLWFASNPSFLENAGERGSLYIHYIVERLEERNMPLELALLPVIESAYNPMAYSRADAVGLWQFIPSTGRYFNLRQTRFYDGRRDITASTTAAMDYLTRLHDMFNGDWLLALAAYNAGEGTVSRAIERNEKLGLPTDYWNLPLPAETQAYVPKLLALSQVVLAPEAYGVNLNPIANEPYFQVVEINQRMDLSKVAAVANIDEDELFQLNPAFKQRTTIDGPQHLLVPTSKAQLLTASLQTMRPDELISPRSLKPVFEGADPSEVAQLKRAYRVKRGDNLGSIAKANKVEVKDLQRWNKLTGKNLKVGQTLVMQDNTKRAPARKSGRVNTVVAANTKTKGKNESKQQTQYKVKRGDTLYVVAKRFNVEMQHLKRWNPGAGKALKPGQMLTVYQPH

SEQ ID NO: 3989 - protein, 488 aa, Pseudomonas sp.
MSSSIRKSVNSDTLTRLAQAIAVAVSATLAGCSSHAPQTEASHTPNIAARAKQKPIWLTEKPSPQVPQDIWERMRGGFQLQDGLGVNPRIEQQRLWFASNPSFLENAGERGSLYIHYIVERLEERNMPLELALLPVIESAYNPMAYSRADASGLWQFIPSTGRYYNLRQTRFYDGRRDITASTTAAMDYLTRLHDMFNGDWLLALAAYNAGEGTVSRAIERNEKLGLPTDYWNLSSLPAETQAYVPKLLALSQVVLAPEAYGVNLNPIANEPYFQVVEINQRMDLSKVAAVANIDEDELFQLNPAFKQRTTVDGPQHLLVPTSKAQLLTASLQTMRPEELISPRSLKPVFDGADPSEVAKLKRAYRVKRGDNLGSIAKANKVEVKDLQRWNKLTGKNLKVGQTLVMQDTTKRTPARSGGRVNTVIAANSKTKGKADSQQQTQYKVKRGDTLYVVAKRFNVEMQHLKRWNPGAGKALKPGQMLTVYQPH

SEQ ID NO: 3990 - protein, 476 aa, Pseudomonas sp.
MSSPIRKAISSDALTRLAQAIAVAVSATLAGCSSHAPQTDAAHTQNIAARAKQKPIWLSEKPSPQIPQDVWERMRQGFQLQDGLGVNPRIEQQRLWFASNPSFLENAGERGSLYIHYIVERLEERNMPLELALLPVIESAYNPMAYSRANAVGLWQFIPSTGRYFNLRQTRFYDGRRDITASTTAALDYLTRLHDMFNGDWMLALAAYNAGEGTVSRAIERNERLGLPTDYWNLPLPSETQAYVPKLLALSQVVMAPEAYGVNLNPIANEPYFQVVEINQRMDLSKVAEVANIDEDELFQLNPAFKQRTTLDGPQHLLVPTSKAQLLTSSLQTMRPEELISKKSLKPVFEGADDSQVASVKRSYRVKRGDNLGSIAKANNVDVKDLQRWNKLSGKNLKPGQTLVMQDNSKRNSGRVNTVIAANTKKQQAKYKVQQGDSLYIVAKRFNVEMQHLKRWNPRVGQALKPGQMLTVANPH

SEQ ID NO: 3991 - protein, 483 aa, Pseudomonas sp.
MSSSIRKSINSDALTRLAQAIAVAVSATLAGCQSTSHVPQTDASHTQNFNARIKQKPIWLSEKPSPQLPQDVWARMREGFQLQDGIGVNPRIEQQRLWFASNPSFLENASERGSLYIHYIVERLEERNMPLELALLPVIESAYNPMAYSRADAVGLWQFIPSTGRSFNLRQTRFYDGRRDITASTTAAMDYLTRLHDMFNGDWLLALAAYNAGEGTVSRAIERNEKLGLPTDYWNLPLPAETQAYVPKLLALSQVVLAPEAYGVNLNPIANEPYFQVVEINQRMDLSKVAAVANIDEDELFQLNPAFKQRTTIDGPQHLLVPTSKAQLLSASLSTMKPEELISQRSFKPVFEGADSREMAQAKRSYRVKRGDNLSQIAKANKVDVKDLQRWNKLSGKNLKVGQTLVMQDTRKASTKTNAKASGKKTMVASADKKSTQYKVKQGDSLYMVAKRFNVEMQHLKRWNPRAGQALKPGQMLTVYLPH

SEQ ID NO: 3992 - protein, 479 aa, Pseudomonas sp.
MSSSIRRSVQSDTLTRLAQAIAVAVSATLAGCQSTSQVSQTDAAHTPNIAARAKQKPVWLSEKPSPQVPQDVWERMRQGFQLQETAGVNPRIEQQRLWFASNPSFLENAGERGSLYIHYIVERLEERNMPLELALLPVIESAYNPMAYSRANAVGLWQFIPSTGRYFNLRQTRFYDGRRDITASTTAAMDYLTRLHDMFNGDWLLALAAYNAGEGTVSRAIERNEKLGLPTDYWNLPLPSETQAYVPKLLALSQVVLSPDAYGVNLNPIANEPYFQVVEINQRMDLSKVAAVANIDEDELFQLNPAFKQRTTIDGPQHLLVPTSKAQLLTASLSTMRPEELISPRSLQPVFETADDSEVEGARRTYRVKRGENLAQIAKANNVQTKDLQRWNKLSGNKLKVGQTLVMQDAKATGKRISTVVAANSKDQKKQTQYKVKQGDSLYVVAKRFNVEMQHLKRWNPRMGNALKPGQMLTVYSPH

SEQ ID NO: 3993 - protein, 482 aa, Pseudomonas sp.
MSSSIRRSVQSDTLTRLAQAIAVAVSATLAGCQSTSQLPQTDAAHTPNIAARAKQKPVWLSEKPSPQVPQDVWERMRQGFQLQETAGVNPRIEQQRLWFASNPSFMENAGERGSLYIHYIVERLEERNMPLELALLPVIESAYNPMAYSRANAVGLWQFIPSTGRYFNLRQTRFYDGRRDITASTTAALDYLTRLHDMFNGDWLLALAAYNAGEGTVSRAIERNEKLGLPTDYWNLPLPSETQAYVPKLLALSQVVLSPDAYGVNLNPIANEPYFQVVEINQRMDLSKVAAVANIDEDELFQLNPAFKQRTTIDGPQHLLVPTSKAQLLTASLSTMRPEELISQRSLKPVFETADDSDVEGARRTYRVKRGESLAQIAKANNVQTKDLQRWNKLSGNKLKVGQTLVMQDAKASKATSKRISTVVAANSKDQKKQTQYKVKQGDSLYVVAKRFNVEMQHLKRWNPRMGKALKPGQMLTVYSPH

SEQ ID NO: 3994 - protein, 483 aa, Pseudomonas sp.
MSSSIRRSVPSATLTRLAQAIAVAVSAILAGCQSSGQIPQNDAVTPKNMAARAKQKPVWLSEKPSPQAPQDIWERMRQGFQLQETAGVNPRIEQQRLWFASNPAFLEGAGERGSLYMHYIVERLEERNMPLELALLPVIESAYNPMAYSRANAVGLWQFIPSTGRYFNLRQTRFYDGRRDITASTTAALDYLTRLHDMFNGDWLLALAAYNAGEGTVSRAIERNEKLGLPTDYWNLPLPAETQAYVPKLLALSQVVLAPEAYGVNLNPIANEPYFQVVEINQRMDLSKVAEVANIDEDELFQLNPAFKQRTTIDGPQHLLVPTSKAQLLTASLSTMRPEELISQRSLKPVFESADDAEVEGARRTYRVKRGDNLGQIAKANHVQTKDLQRWNKLSGSKLKIGQTLVMQDARPAKATGKRINTVVAANSTKEKTKQTQYKVKQGDSLYVVAKRFNVEMQHLKRWNPRMGKALKPGQMLTVYSPH

SEQ ID NO: 3995 - protein, 469 aa, Pseudomonas sp.
MAQAIAVAVSATLAGCQSTSHVPQTDASHTQNFNARIKQKPIWLNEKPSPQLPQDVWERMREGFQLQEGIGVNPRIEQQRLWFASNPSFLENASERGSLYIHYIVERLEERNMPLELALLPVIESAYNPMAYSRADAVGLWQFIPSTGRSFNLRQTRFYDGRRDITASTTAAMDYLTRLHDMFNGDWLLALAAYNAGEGTVSRAIERNEKLGLPTDYWNLPLPSETQAYVPKLLALSQVVMAPEAYGVNLNPIANEPYFQVVEINQRMDLSKVAAVANIDEDELFQLNPAFKQRTTIDGPQHLLVPTSKAQLLSASLSTMKPEELISQRSLKPVFEGADSREMAQAKRNYRVKRGDNLSQIAKANKVDVKDLQRWNKLSGKQLKVGQTLVMQDTSKAKGSSKTSAKASGKKTLVASADKKSTQYKVKQGDSLYMVAKRFNVEMQHLKRWNPRAGQALKPGQMLTVYLPH

SEQ ID NO: 3996 - protein, 466 aa, Pseudomonas sp.
MAQAIAVAVSATLAGCQSTSQLPQTDAAHTPNIAARAKQKPVWLSEKPSPQVPQDVWERMRQGFQLQETVGVNPRIEQQRLWFASNPSFMENAGERGSLYIHYIVERLEERNMPLELALLPVIESAYNPMAYSRANAVGLWQFIPSTGRYFNLRQTRFYDGRRDITASTTAALDYLTRLHDMFNGDWLLALAAYNAGEGTVSRAIERNEKLGLPTDYWNLPLPSETQAYVPKLLALSQVVLSPDAYGVNLNPIANEPYFQVVEINQRMDLSKVAAVANIDEDELFQLNPAFKQRTTIDGPQHLLVPTSKAQLLTASLSTMRPEELISQRSLKPVFETADDSDVEGARRTYRVKRGENLAQIAKANNVQTKDLQRWNKLSGNKLKVGQTLVMQDAKASKATSKRISTVVAANSKDQKKQTQYKVKQGDSLYVVAKRFNVEMQHLKRWNPRMGKALKPGQMLTVYSPH

SEQ ID NO: 3997 - protein, 470 aa, Pseudomonas sp.
MSSSIRKSNHSDALTRLAQAIAVAVSATLAGCQTTNYAAQSTVQPKPVLTAKIKQKPLWLSEKPSPQVPQDVWERMRQGFQLQDGVGVNPRIEQQRLWFASNPSFLENAGERGSLYIHYIVERLEERNMPLELALLPVIESAYNPMAYSRSDAVGLWQFIPSTGRYFNLRQTRAYDGRRDITASTTAALDYLTRLHDMFNGDWLLALAAYNAGEGTVSRAIERNEKLGLPTDYWNLPLPQETKDYVPKFLALSQVVLAPEAYGVNLNPIANAPYFEMVEVKQSMDLSRVAALAEIDEDELFQLNPAFKQRTTLDGPQHLLVPTSKAQLLASSLSSMNPEELLSLRPKKPVFDEVEHKAVAGRSRSYKVKSGDNLTLIAKANKVDVHDLQRWNKLNGQALKVGQTLVMQDTRKVVAKAGGKKPVQYKVKKGDSLYMVAKRFNVEMQHLKRWNPRTGQALKPGQMLVVSGPR

SEQ ID NO: 3998 - protein, 469 aa, Pseudomonas sp.
MSSSIRKSNHSDALTRLAQAVAVAVSATLAGCQSTNFTAQSTVQPKPNLTAKIKQKPVIWLSEKPAPEVPQDVWERMRRGFQLQDNVGVNPRIEQQRLWFASNPSFLENAGERGSLYIHYIVERLEERNMPLELALLPVIESAYNPMAYSRSDAVGLWQFIPSTGRYFNLRQTRAYDGRRDITASTTAALDYLTRLHDMFNGDWLLALAAYNAGEGTVSRAIERNEKLGLPTDYWNLPLPQETKDYVPKFLALSQVVLAPEAYGVNLNPIANTPYFEVVEVKQSMDLSRVAALAEIDEDELFQLNPALKQRTTLDGPQHLLVPSSKAQLLTSTLSTMKPEELLAMRPKKQVFDEVETARVAGRSRSYKVRSGDNLTLIAKANKVDVHDLQRWNKLNGQALKVGQTLVMQDTRRAVASSKKPVQYKVKKGDSLYIVAKRFNVEMQHLKRWNPRTGQALKPGQMLVVSGPR

SEQ ID NO: 3999 - protein, 467 aa, Pseudomonas sp.
MSSLNRKSINKDALTRLAQAIAVAVSATLAGCQSFHHPADNSTEPAPNLSARIKQKPIWLGEKANPTPPQDVWERMRQGFKLQDGLGVNPRIEQQRLWFASNPSFLENAGERGTLYIHYIVERLEERNMPLELALLPVIESAYNPMAYSRADAVGLWQFIPSTGRYFNLRQDRFYDGRRDITASTLAAMNYLTRLHDMFNGDWLLALAAYNAGEGTVSRAIERNEKLGLPTDYWNLPLPQETRDYVPKLLALSQVVMAPEAYGVNLNPIANEPYFATVEVNQPMDLSRVAALAEIDEDEMIQLNPAYKQKATLDGPQHLLVPSSKAQLLTASLSNLKPEELVSLRPKKPVFENVASNDPVRLNRRYKVKNGDNLTSIAKANKVDVKDLQHWNKLSGQKLKIGQTLVMQDNVRAEASQQATTYKVQKGDSLYIVAKRFNLEMQHLKRLNPRTGQALKPGQILTVSQSR

SEQ ID NO: 4000 - protein, 466 aa, Pseudomonas sp.
MSSFKGYSINSDALTRLVKAIAVAVSATLAGCQSMDHSAQTTERASLKIAKRIPQEPLWLSEKPSPVAPQDVWERMRQGFKLQDGQNVNPRIEQQRLWFASNPSFLENAGERGSLYIHYIVERLEERNMPLELALLPAIESAYNPMAYSHANAVGLWQFIPSTGRYFNLRQTRAYDGRRDITASTLAALNYLNRLHDMFNGDWLLALAAYNAGEGTVSRAIERNEKLGLPTDYWNLPLPQETKDYVPKLLALSQVVLAPEAYGINLNPIANEPYFEMVEIKQSMDLSRVAALAEIDEDEMFQLNPAYKQRATTDGPQHLLVPTSKAQLLTASLSNLKPEELVSLRPKKPVFDSIASNQPARLNRKYRVKSGDNLTLIAKANKVDVKDLQHWNKLSGNNLKAGQILVMQDTRKSTGRKPTQYKVKKGDSLYIVAKRFNVEMQHLKRWNPSSAKALKPGQMLTVSKPR

SEQ ID NO: 4001 - protein, 467 aa, Pseudomonas sp.
MSSSIRNFIKTDTLTRLAQAIALAVSAVLAGCQSMDQSAKTAERPTLKLTKRIPQEPIWLSEKPSPVAPQDVWERMRQGFKLQEGVEVNPRIEQQRLWFASNPSFLENAGERGSLYIHYIVERLEERNMPLELALLPVIESAYNPMAYSHANAVGLWQFIPSTGRYFNLRQTRAYDGRKDITASTLAAMNYLTRLHDMFNGDWLLALAAYNAGEGTVSRAIERNEKLGLPTDYWNLPLPQETKDYVPKLLALSQVVMAPEAYGINLNPIANEPYFEMVEIKQSMDLSRVAALAEIDEDEMFQLNPAYKQRATTDGPQHLLVPTSKAQLLTTSLSNLRPDELISLRPKKAVFDNVASNTAVRLNRKYKVKSGDNLTTIAKANKVNVRDLQRWNKLTGKNLKSGQMLVMQDTRKPAASKKATQYKVKKGDSLYIVAKRFNVEMQHLKRWNPNSAKALKPGQMLTVSNPR

SEQ ID NO: 4002 - protein, 467 aa, Pseudomonas sp.
MLSPNRKTINSGTLTRLAQAVAVAVSATLAGCQGLHHPSDNGTETASNLNVRIKQKPIWVGEKTNPTPPQDVWERMRQGFKLQDGLGVNPRIEQQRLWFASNPSFLENASERGTLYIHYIVERLEERNMPLELALLPVIESAYNPMAYSRADAVGLWQFIPSTGRNFNLRQDRFYDGRRDITASTIAALNYLTRLHDMFNGDWLLAMAAYNAGEGTVSRAIERNEKLGLPTDYWNLPLPQETRDYVPKLLALSQVVMSPEAYGVNLNPIANEPYFASIEVNQPMDLSRVAALAEIDEDEMIQLNPAYKQKATLDGPQHLLVPSSKAQLLTASLSNLKPEELVSLRPKKPVFESVASNGPVRRYKVRNGDSLSSIAKANKVDIKELQRLNKLSGHKLKVGQTLVMQGNVRAPISKKSAAPTTYKVQKGDSLYIVAKRFNVEMQHLKRLNPRTGQALKPGQILTVSQPH

SEQ ID NO: 4003 - protein, 407 aa, Pseudomonas sp.
MRQGFQLQETAGVNPRIEQQRLWFASNPSFLENAGERGSLYIHYIVERLEERNMPLELALLPVIESAYNPMAYSRANAVGLWQFIPSTGRYFNLRQTRFYDGRRDITASTTAAMDYLTRLHDMFNGDWLLALAAYNAGEGTVSRAIERNEKLGLPTDYWNLPLPSETQAYVPKLLALSQVVLSPDAYGVNLNPIANEPYFQVVEINQRMDLSKVAAVANIDEDELFQLNPAFKQRTTIDGPQHLLVPTSKAQLLTASLSTMRPEELISQRSLKPVFESADDSDVAGAKRTYRVKRGDNLAQIAKANNVQTKDLQRWNKLSGNKLKVGQTLVMQDAKASKAAGKRISTVVAANSKDQKKQTQYKVKQGDSLYVVAKRFNVEMQHLKRWNPRMGKALKPGQMLTVYSPH

SEQ ID NO: 4004 - protein, 467 aa, unknown
  environmental sample
MSSSIRKPSQFDTLTRLAQAIALALSATLVGCQSTSHTPDMEPVRAHNLNNRIKQKPLFVNQQPAQQAPQDVWERMRQGFQLQDSVAVNPRVEQQRLWFVSNPTFLETASDRGSLYMHYVVERLEERDMPLELALLPVIESAYNPMAYSRANAAGLWQFIPSTGRYFNLSQTRFYDGRRDVTASTAAALDYLTRLHDMFNGDWLLALAAYNAGEGTVSRAMERNEKLGLPTDYWNLPLPQETRDYVPKLLALSELVMSPQAYGVNLSPIANEPYFEVVEVNQRMDLSRVAALADIDEDEMFQLNPAFKQRVTVQPKQHLLIPTAKAQLLTASLSNMRPDELLSLQPQKKVFEDVAVVEPARKRVYKVRAGDNLGLIAKANKVDIKDLQRWNRTSGKNLKVGQTLVMQDTSAPQSSKQKTTTYKVRKGDSLYLVAKRFNVEMQHLKRWNPRTGHALKPGQTLTVYLDR

SEQ ID NO: 4005 - protein, 522 aa, Pseudomonas sp.
MSSSIRYSISSDALTRLAQAIAVAVSATLAGCQSTGHAPQSDATHTQNFNARIKQKPIWLSNKPSPQVPQDVWERMRQGFQLQEGLGVNPRIEQQRLWFASNPSFLENAGERGSLYIHYIVERLEERNMPLELALLPVIESAYNPLAYSRADAVGLWQFVPATGRYFNLRQTRFYDGRRDITASTTAALDYLTRLHDMFNGDWLLALAAYNAGEGTVSRAIERNDKLGLPTDYWNLPLPAETQAYVPKLLALSQVVLAPQAYGVNLNPIANEPYFQVVEINQRMDLSKVAAVANIDEDELFQLNPAFKQRTTVDGPQHLLVPTSKAQLLTTSLSTMKPEELISKRSLKPVFDRDEGRDSLRPKRIYRVKNGDNLTLIAKANKVDVQDLQRWNKLSGKNLKVGQTLVMQDTRKAAGKKPAWPAAASRSRPATRSSKATRCTSWPSVSMSRCSTSSAGTRGRRKPSSRARCSRSTCHTETRSVGAGLPANSLRRQAGSYRRFQLHKARASELFPADTSCYCTEH

SEQ ID NO: 4006 - protein, 471 aa, Pseudomonas sp.
MSSRSRRTPHSVALRRLAQISALALAATLVGCQSTRQLDEAESVRAHNYQARIKHKPAPLAVKPVEPPQDVWERMRQGFALQDSIDVNPRIEQQRLWFASNPSFLENAGERGSLYLHYIVERLEERDMPLELALLPAIESAYNPMAYSRAHAAGMWQFIPSTGRHFNLRQTNFYDGRRDVTASTNAALDYLTRLHDMFNGDWLLALAAYNAGEGTVSRAIERNEKLGLPTDYWNLPLPQETRDYVPKLLALSQVVSTPEAYGVNLNPIANEPYFEAVAINERLDLSRVAAFANIDEDELIQLNPAFKKRMTVDGPQQLLVPTAKAQLLTDLKPEQLISLKPNKAVFERAVAEARAPATARTYRVKRGDNLGTIAKANRVSVKDIQRWNKLPGNRVKAGQVLALRGGNAPSAAGNRVAASGERTTQYKVRKGDSLYLVAKRFNVEMQHLKRWNPRSGHALKPGQTLTVYLPH

SEQ ID NO: 4007 - protein, 429 aa, Pseudomonas sp.
MSSSIRKSISSDALTRLAQAVAVAVSATLAGCQSTNYAAQSTVQPKPNLAAKIKQKPIWLSEKPSPEVPQDVWERMRRGFQLQDGVGVNPRIEQQRLWFASNPSFLENAGERGSLYIHYIVERLEERNMPLELALLPVIESAYNPMAYSRSDAVGLWQFIPSTGRYFNLRQTRAYDGRRDITASTTAALDYLTRLHDMFNGDWLLALAAYNAGEGTVSRAIERNEKLGLPTDYWNLPLPQETKDYVPKFLALSQVVLAPEAYGVNLNPIANTPYFEVVEVKQSMDLSRVAALAEIDEDELFQLNPALKQRTTLDGPQHLLVPTSKAQLLTSTLSTMKPEELLSMRPKKPVFDEVETKAVAGRTRSYKVRSGDNLTLIAKANKVDVHDLQRWNKLNGQALKVGQTLVMQDTRKVAAKKPVQYKVKKGDSL

SEQ ID NO: 4008 - protein, 256 aa, Pseudomonas sp.
MKPLSKLCLIAASLLMLGTGSAMASDIAPVKANNVVLVHGSWADGSSWADVISRLQAAGLHVTAVQNPLTSVADDVAATQRVLNQQDGPTVLVGHSYAGTVVSEAGVNPKVSSLVYVAARAPDAGEDFVALSGKYPTMPVRAGTEEHDGFVSLKQDAFLKYFASDVPHDKAMQLFAVQQPIAKTLFTDRTTAAAWHSKPSWYAVSSLDQTINPDLERFLAKRMGATTIELPSSHLSLVSHSKEIADLILEASGRQP

SEQ ID NO: 4009 - protein, 256 aa, Pseudomonas sp.
MKPLNKLCLIAASLLMLGTGSAMAGDIAPVKADNVVLVHGSWADGSSWADVISRLQAAGLHVTAVQNPLTSVADDVAATQRVLNQQDGPTVLVGHSYAGTVVSEAGVNPKVSSLVYVAARAPDAGEDFVALSAKYPTMPVRAGTEEHDGFVSLKQDAFLKYFASDVPHDKAMQLFAVQQPIAKTLFTDRTTAAAWHSKPSWYAVSSLDQTINPDLERFLAKRMGATTIELPSSHLSLVSHSKEIADLILEASGRQP

SEQ ID NO: 4010 - protein, 256 aa, Pseudomonas sp.
MKPLSKLCLIAASLFMLGSGSAMAASTAPVKANNVVLVHGSWADGSSWSDVIARLQAAGLHVTAVQNPLTSVADDVAATQRVLDQQDGPTVLVGHSYAGTVVSEAGVNPKVSSLVYVAARAPDAGEDFVALSAKYPTMPVRAGTEEHDGFISLKQDAFLKYFASDVPHDKAMQLFAVQQPIAKTLFTDRTTAAAWHTKPSWYAVSSQDQTINPDLERFLAKRMGATTIELPSSHLSLVSHSKEIADLILAAAGRQS

SEQ ID NO: 4011 - protein, 253 aa, Pseudomonas sp.
MSKLCLIAASLLILGTGSAMASDIAPVKANNVVLVHGSWADGSSWSDVITRLQAAGLHVTAVQNPLTSVADDVAATQRVLDRQDGPTVLVGHSYAGTVVSEAGVNPNVSSLVYVAARAPDAGEDFVALSAKYPTMPVRAGTEEHDGFISLKQDAFLKYFASDVPHEKAMELFAVQQPIAKTLFTDRTTAAAWHTKPSWYAVSSLDQAINPDLERFLAKRMNATTIELPSSHLSLVSHAKEIADLILEAAGRQP

SEQ ID NO: 4012 - protein, 257 aa, Pseudomonas sp.
MKPLSKLCLIAATLFVLSSGCAMAATTTAPVKANNVVLVHGSWADGSSWSDVISRLQAAGLHVTAVQNPLTSVADDVAATQRVLDQQDGPTVLVGHSYAGTVVSEAGVNPKVSSLVYVAARAPDAGEDFVALSARYPTMPVRAGTEEHDGFVSLKQDAFLNYFASDVPRDKAMQLFAVQQPIAKTLFSERTTAAAWHTKPSWYAVSSQDQTINPDLERFLARRMGATTIELPSSHLSLVSHSREIADLILAAAGRQP

SEQ ID NO: 4013 - protein, 256 aa, Pseudomonas sp.
MKPASKLCLIAASLLMLGTGSAMAGTIAPVKAKNVVLVHGSWADGSSWSEVITRLQAAGLHVTAVQNPLTSVADDVAATHRVLDQQDGPTVLVGHSYAGTVVSDAGVNPKVSALVYVAARAPDANEDFVALSAKYPTMPVRAGVEDHDGYLTLSQDAFLKYFAADVPHAKAMELYAVQQPITKTLFSGRTVNAAWHTKPSWYAVSANDQTINPDLERFLAKRMNATTIELPSSHLSLVSHAKEITDLILEASGRQP

SEQ ID NO: 4014 - protein, 256 aa, Pseudomonas sp.
MKPASKLCLIAASLLMLGTGAAVAGPIAPVKANNVVLVHGSWADGSSWSEVITRLQAAGLHVTAVQNPLTSVADDVAATNRVLDQQDGPTVLVGHSYAGTVVSDAGANPKVSSLVYVAARAPDANEDFVALSAKYPSTPVRAGVVEHDGYLTLNQDAFLKYFAADVPHAKAMELYAVQQPIAKTLFSGRTVNAAWHTKPSWYAVSSNDQTINPDLERFLAKRMNATTIELPSSHLSLVSHAKEITDLILEASGRQP

SEQ ID NO: 4015 - protein, 256 aa, Pseudomonas sp.
MKPASKLCLIAASLLMLGTGAAVAGPIAPVKANNVVLVHGSWADGSSWSEVITRLQAAGLHVTAVQNPLTSVADDVAATNRVLDQQDGPTVLVGHSYAGTVVSDAGANPKVSSLVYVAARAPDANEDFVALSAKYPSTPVRAGVVEHDGYLTLNQDAFLKYFAADVPHAKAMELYAVQQPIAKTLFSGRTVNAAWHTKPSWYAVSSNDQTINPDLERFLAKRMNATTIEVPSSHLSLVSHAKEITDLILEASGRQP

SEQ ID NO: 4016 - protein, 256 aa, Pseudomonas sp.
MKPASKLCLVAASLLMLGTGTAMAGTVAPVKANNVVLVHGSWADGSSWSEVITRLQAAGLHVTAVQNPLTSVADDVAATNRVLDQQDGPTVLVGHSYAGTVVSDAGANPKVSSLVYVAARAPDANEDFVALSAKYPTMPVRAGVEDHDGYLTLSQDAFLKYFATDVPHAKAMELYAVQQPITKALFSGRTVNAAWHTKPSWYAVSANDQTINPDLERFLAKRMNATTVELPSSHLSLVSHAKEITDLILEASGRQP

SEQ ID NO: 4017 - protein, 256 aa, Pseudomonas sp.
MKPASKLCLIAASLLMLGTGTAMAATVAPVKANNVVLVHGSWADGSSWSEVITRLQAAGLHVTAVQNPLTSVADDVAATNRVLAQQDGPTVLVGHSYAGTVVSDAGVNPKVSALVYVAARAPDANEDFVALSAKYPTMPVRAGVEDHDGYLTLSQDAFLNYFAADVPRAKALALYAVQQPITKTLFSGRTVNAAWHTKPSWYAVSANDQTINPDLERFLAKRMNATTIELPSSHLSLVSHAKEITDLILEASGRQP

SEQ ID NO: 4018 - protein, 256 aa, Pseudomonas sp.
MKPASKLCLIAATLLMLGTGTAMAGTVAPVKANNVVLVHGSWADGSSWSEVITRLQAAGLHVTAVQNPLTSVADDVAATNRVLDQQDGPTVLVGHSYAGTVVSDAGVNPNVSALVYVAARAPDANEDFVALSAKYPTMPVRAGVEDHGGYLTLNQDAFLKYFAADVPRAKAMQLYAVQQPITKTLFSGRTVNAAWHTKPSWYAVSANDQTINPDLERFLAKRMDATTIELPSSHLSLVSHAKEITDLILEASGRQP

SEQ ID NO: 4019 - protein, 256 aa, Pseudomonas sp.
MKPASKLCLIAASLLILGTGTAMAGTVAPIKANNVVLVHGSWADGSSWSEVITRLQAAGLHVTAVQNPLTSVADDVAATNRVLDQQDGPTVLVGHSYAGTVVSDAGANPKVSSLVYVAARAPDANEDFVALSAKYPSTPVRAGVVEHDGYLTLNQDAFLKYFAADVPRAKALQLYAVQQPIAKTLFNGRTVNAAWHTKPSWYAVSSNDQTINPDLERFLAKRMNATTIELPSSHLSLVSHAKAITDLILEASGRQP

SEQ ID NO: 4020 - protein, 260 aa, Pseudomonas sp.
MKPASKLCLIATSLLMLGTGTALAGTVASVNANNVVLVHGSWADGSSWSEVITRLQAAGLHVTAVQNPLTSVADDVAATKRVLDQQDGPTVLVGHSYAGTVVSDAGVDPKVSALVYVAARAPDANEDFVALSAQYPSMPVRSGVEDHDGYLTLSQDAFLKYFAADVPQAKALALYAVQQPITKTLFSGRTVNAAWHTKPSWYAVSANDQTINPDLERFLAKRMNATTIELPSSHLSLVSHAKEITDLILEASGRPPEALH

SEQ ID NO: 4021 - protein, 272 aa, Pseudomonas sp.
MTPLPTDEKGYPMKPASKLCLIAASLLMLGTGTALAGTVASVKANNVVLVHGSWADGSSWSEVITRLQAAGLHVTAVQNPLTSVADDVAATKRVLDQQDGPTVLVGHSYAGTVVSDAGVDPKVSALVYVAARAPDANEDFVALSAQYPSMPVRAGVEDHDGYLTLSQDAFLKYFAADVPQAKALALYAVQQPITKTLFSGRTVNAAWHTKPSWYAVSANDQTINPDLERFLAKRMNATTIELPSSHLSLVSHAKEITDLILEASGRPPEALH

SEQ ID NO: 4022 - protein, 258 aa, Collimonas sp.
MKTRVKLSLIAFSLAATAFGSTPVFAQSAVPPKAVNVVLVHGAWADGSSWANVIPRLQAAGLNVTSVQNPLTSLADDVAATRRVLALQNGPTVLVGHSWAGTIVSEAGDDPKVTTLVYVAARAPDAGEDFNALAARYPTMPVRAGAKDHDGYVTLTEDAYLKYFGGDLPHDQALSLYATQQPIAKTLFSGRTTVAAWHDKPSWYAVSKQDQTTSPDLERFLAQRMHATTIELDSSHLSLVSHPKEIADLILAAAGRTQ

SEQ ID NO: 4023 - protein, 477 aa, Pseudomonas sp.
MTFLRPTLLTLACLLASPGFADDLPSLGDASSAIVSPQQEHQLGRAWLALLRSQVSQLNDPQLKDYVESSVYRLVETSQVNDRRLEFILINSPQLNAFAAPGGIVGVNGGLFLNAQTEGEYASVMAHELAHLSQRHFARGVEASQRMQVPMMAALLAGIVIAAAGAGDAGIAAIAGTQAAAIQEQRRFSRQNEQEADRIGIMNLEKAGYDPRSMPTMFERLMRQYRFDAKPPEFLLTHPVTESRIADTRNRAEQAKPGGIEDSMRYQLIRARVQLIYEETPGLGAKRFRAQLDENPKNDVARYGLAIAQIKGGQLNEARENLKLLLAKSPNEIIYNLAQVDLDITNNRLPDAQSRVDRMLTQYPGNYPLNQVRVDLLLKQNRASDAEKALETLLKSRPDDPDVWYMVAETRGLSGNIIGLHQARAEYFALVGDYRQAIQQLDFAKRKAGSNFPLSSRIDARQRELMEQERMVKDMMG

SEQ ID NO: 4024 - protein, 477 aa, Pseudomonas sp.
MTFLRPTLLTLACLLASPGFADDLPSLGDASSAIVSPQQEYQLGRAWLALLRSQVSQLNDPQLKDYVESSVYRLVETSQVNDRRLEFILINSPQLNAFAAPGGIVGVNGGLFLNAQTEGEYASVMAHELAHLSQRHFARGVEAQQRMQVPMMAALLAGIVIAAAGAGDAGIAAIAGTQAAAIQEQRRFSRQNEQEADRIGILNLEKAGYDPRSMPSMFERLGRQYRFDAKPPEFLLTHPVTESRIADTRNRAEQARQGGIEDTVRYQLIRARVQLIYEETPGLGAKRFRAQLDENPKSDVARYGLAIAQIKGGQLNEARENLKLLLTKAPNEIIYNLAQIDLDITNNRLADAQTRADRMLSQYPGNYPLNQVRVDLLLKQNRAADAEKALESLLKSRPDDPDVWYQVAETRGLSGNIIGLHQARAEYFALVGDYRQAIQQLDFAKRKAGSNFPLSSRIDARQRELMEQERMIKDMMG

SEQ ID NO: 4025 - protein, 477 aa, Pseudomonas sp.
MTFLRPTLLTLACLLASPGFADDLPSLGDASSAIVSPQQEYQLGRAWLAMLRSQVSQLNDPQLKNYVESSVYRLVETSQVTDRRLEFILINSPQLNAFAAPGGIVGVNGGLFLYAQTEGEYASVLAHELAHLSQRHFARGVEAQQRMQVPMMAALLAGIVLAAAGGGDAGIAAIAGTQAAAIQEQRRFSRQNEQEADRIGILNLEKAGYDPRSMPTMFERLGRQYRYDAKPPEFLLTHPVTESRIADTRNRAEQFPAGGIEDSMRYQLIRARVQLIYEETPGLGAKRFRAQLDENPKNDVARYGLAIAQIKGGQLNEARENLKQLLAKSPNEIIYNLAQVDLDITNNRLADAQSRVDRLMGQYSGNYPLNQMRVDLLLKQNRTADAEKALEGLLKSRPDDPDVWYQVAETRGLSGNIIGLHQARAEYFALVGDYKQAIQQLDFAKRRAGSNFPLSSRIDARQRELMEQERMIKDMMG

SEQ ID NO: 4026 - protein, 477 aa, Pseudomonas sp.
MTFLRPTLLTLACLLASPGFADDLPSLGDASSAIVSPEQEHQLGRAWLALLRSQVSQLNDPQLKDYVESSVYKLVETSQVNDRRLEFILINSPQLNAFAAPGGIVGVNGGLFLNAQTEGEYASVMAHELAHLSQRHFARGVEAQQRMQVPMMAALLAGIVIAAAGGGDAGIAAIAGTQAAAIQEQRRFSRQNEQEADRIGIQNLEKAGYDPRSMPTMFERLMRQYRFDARPPEFLLTHPVTESRIADTRNRAEQAKPGGIEDSVRYQLIRARVQLTYEETPGLAAKRFRAQLDENPKNDVARYGLAIAQIKGGQLNEARENLQPLLAKSPNEIIYNLAQVDLDITNNKLADAQSRVERMLSQYPGNYPLNQVRVDLLLKQNRPADAEKALESLLKTRPDDPDVWYMVAETRGLSGNIIGLHQARAEYFALVGDYRQAIQQLDFAKRRAGTNFPLSSRIDARQRELMEQERMVKDMMG

SEQ ID NO: 4027 - protein, 477 aa, Pseudomonas sp.
MTFLRPTLLTLACLLASPGFADDLPSLGDASSAIVSPQQEYQLGRAWLAMLRSQVSQLNDPQLKNYVESSVYRLLETSQVTDRRLEFILINSPQLNAFAAPGGIVGVNGGLFLYAQTEGEYASVLAHELAHLSQRHFARGVEAQQRMQVPMMAALLAGIVVAAAGGGDAGIAAIAGTQAAALQEQRRFSRQNEQEADRIGLLNLEKAGYDPRSMPSMFERLGRQYRYDAKPPEFLLTHPVTESRIADTRNRAEQFPAGGIEDSMRYQLIRARVQLIYEETPGLGAKRFRAQLDENPKSDVARYGLAIAQIKGGRLNEARENLTQLLAKSPNEIIYNLAQVDLDITNNRLADAQSRVDRLMGQYSGNYPLNQMRVDLLLKQNRTADAEKALDGLLKSRPDDPDVWYQVAETRGLSGNIIGLHQARAEYFALVGDYKQAIQQLDFAKRRAGSNFPLSSRIDARQRELMEQERMIKDMMG

SEQ ID NO: 4028 - protein, 477 aa, Pseudomonas sp.
MTFLRPTLLTLACLLASPGFADDLPSLGDASSAIVSPQQEYQLGRAWLALLRSQVSQLNDPQLKDYVETSVYKLVETSQVNDRRLEFILIDSPQLNAFAAPGGIIGVNGGLFLNAQTEGEYASVLAHELAHLSQRHFARGVEAQQRMQVPMMAALLAGIVIAAAGAGDAGIAAIAGTQAAAIQEQRRFSRQNEQEADRIGILNLEKAGYDPRSMPSMFERLMRQYRFDAKPPEFLLTHPVTESRIADTRNRAEQAKPGGTEDSMRYQLIRARVQLTYEDSPGLAAKRFRAQLDENPKNDVARYGLAIAQIKGSQWNDARENLKQLLAKSPNDITYNLAQIELDIANNRLPDAQARVDRVLTQYPNNYPLNQVRVDLLLKQNRAADAEKALEGLLKSRPDDPDVWYMVAETRGLSGNTIGLHQARAEYFALVGDYRQAIQQLDFAKRRAGSNFPLSSRIDARQRELMDQEQMVKDMMR

SEQ ID NO: 4029 - protein, 477 aa, Pseudomonas sp.
MTFLRPTLLTLACLLASPGFADDLPSLGDASSAIVSPQQEHQLGRAWLALLRSQVSQLNDPQLKDYVETSVYKLVETSQVNDRRLEFILINSPQLNAFAAPGGIVGVNGGLFLNAQTEGEYASVLAHELAHLSQRHFARGVEASQRLQVPMMAALLAGIVIAAAGGGDAGIAAIAGTQAAAIQEQRRFSRQNEQEADRIGILNLEKAGYDPRSMPTMFERLMRQYRFDAKPPEFLLTHPVTESRIADTRNRAEQAKAGGKEDSLRYQLIRARVQLIYEESPGMGAKRFRAQLDENPKNDIARYGLAIAQIKGSQFNDARENLKQLLAKQPNDITYNLAQIDLDTATSRFSDAQARVDKMLAQYPGNYPLNQVRVDLLLKQNRPADAETALESLLKTRSDDPDVWYSVAETRGLSGNIIGLHQARAEYFALVGDYRQAIQQLDFAKRRAGSNFPLSSRIDARQRELMDQEQMVKDMMR

SEQ ID NO: 4030 - protein, 477 aa, unknown
  environmental sample
MTFLRPTLLTLACLLASPGFADDLPSLGDASSAIVSPQQEYQLGRAWLAYLRGQVSQLNDPQLKDYVETSVYKLVETSQVNDRRLEFILINSPQLNAFAAPGGIVGVNGGLFLNAQTEGEYASVLAHELAHLSQRHFARGVEAQQRMQIPMMAALLGGIIAAAAGAGDAGIAAIAGTQAAAIQEQRRFSRQNEQEADRIGIVNLEKAGYDPRSMPTMFERLGRQYRFDAKPPEFLLTHPVTESRIADTRNRAEQAKPGGKEDSLRYQLIRARVQLQYEDTSGLAAKRFQAQLDENPKNDVARYGLAIAQIKASQFKQARDNLAPLLAKTPNDITYNLAQIQLDIDNNRLPDAQQRTDRLLTQYPGNYPLNQIRVDLLLKQNRTADAEKALDALLKSRPDDPDVWYQVAETRGLSGNIIGLHQARAEYFALVGDFQQAIQQLDFAKRRAGSNFPLSSRIDARQRELIEQERLVKGMMS

SEQ ID NO: 4031 - protein, 477 aa, Pseudomonas sp.
MTFLRPTLLTLACLLASPGFADDLPSLGDASSAIVSPQQEFQLGRAWLAYLRGQVSQLNDPQLKDYVETSVYKLVETSQVNDRRLEFILINSPQLNAFAAPGGIVGVNGGLFLNAQTEGEYASVLAHELAHLSQRHFARGVEAQQRMQIPMMAALLGGIIAAAAGAGDAGIAAIAGTQAAAIQEQRRFSRQNEQEADRIGIVNLEKAGYDPRSMPTMFERLGRQYRFDAKPPEFLLTHPVTESRIADTRNRAEQSKPGGKEDSLRYQLIRARVQLQYEDTSGLAAKRFQAQLDENPKNDVARYGLAIAQIKASQFKQARDSLQTLLAKAPNDITYNLAQIQLDIDNSRLADAQQRTDRMLTQYPGNYPLNQIRVDLLLKQNRTADAEKALDGLLKSRPDDPDVWYQVAETRGLSGNIIGLHQARAEYFALVGDFQQAIQQLDFAKRRAGSNFPLSSRIDARQRELIEQERLVKGMMS

SEQ ID NO: 4032 - protein, 476 aa, Pseudomonas sp.
MNFLRPTLLTLACLLASPSFADDLPSLGDASSAIVSPAQEYQLGRAWLSMLRSQVAQLNDPQLKDYVENSVYKLVETSQVQDRRLEFILIDSPQLNAFAAPGGIIGVNGGLFLNAQTEGEYASVMAHELAHLSQRHFARGVEAQQRMQLPMMAALLAGIVLAASGAGDAGIATIAGTQAAAFQEQRRFSRQNEQEADRIGILNLEKAGYDPRSMPTMFERLMRQYRFDAKPPEFLLTHPVTESRIADTRNRAEQAKIGGTEDSLRYQLIRARVQLQYEDTPGLAAKRFRQQLDENPKNDVARYGLAIAQIKGSQFNDARANLKPLLDKAPNDITYNLAQIQLDMDSNRLADAQQRIDRMRTLYPGNYPLNQARVDLLLKQNRPADAEKALEALLKSRPDDPDVWYLVAETRGLSGNIIGLHQARAEYFALMGDYRKAIQQIAFAKKLTNNFQLSSRLDARQRELMDQERAIKDMMN

SEQ ID NO: 4033 - protein, 476 aa, Pseudomonas sp.
MTFLRPTLLTLACLLASPSFADDLPSLGDASSSIVSPQQEYQLGRAWLSMLRGQVSQLNDPQLKDYVETSVYKLVETSQVQDRRLEFILINSPQLNAFAAPGGIIGVNGGLFLNAQTEGEYASVLAHELAHLSQRHFARGVEAQQRMQMPMMAALLAGIIVAAAGAGDAGIAAIAGTQAAAMQEQRRFSRQNEQEADRIGILNLEKAGYDPRSMPTMFERLMRQYRFDGRPPEFLLTHPVTESRIADTRNRAEQAKLGGTEDSLRYQLIRARVQLNYEETPGLAAKRFRVLLDENPKNDVARYGLAIAQIKGSQFNEARENLKILLEKSPNDITYNLAQIELDTASNRLAEAQQRVDRMRTLYPGNYPLNQARVDLLLKQNRPGEADKALEALLKSRPDDPDVWYSVAETRGLSGNIIGLHQARAEYFALVGDYRQALQQLEFAKKLTNNFQLSSRIDARQRDLLDQERAIKEMMN

SEQ ID NO: 4034 - protein, 476 aa, Pseudomonas sp.
MTFLRPTLLTLACLLASPSFADDLPSLGDASSSIVSPQQEYQLGRAWLSMLRSQVSQLNDPQLKDYVETSVYKLVETSQVQDRRLEFILINSPQLNAFAAPGGIIGVNGGLFLNAQTEGEYASVMAHELAHLSQRHFARGVEAQQRMQLPMMAALLAGIIVAASGAGDAGIAAIAGTQAAAMQEQRRFSRQNEQEADRIGILNLEKAGYDPRSMPTMFERLMRQYRFDGRPPEFLLTHPVTESRIADTRNRAEQARVGGTEDSLRYQLIRARVQLNYEETPGLAAKRFRQQLDENPKNDVARYGLAIAYMKGSQFNEARDTLKPLLEKSPNDITYNLAQIELDMDSNRLAEAQQRIDRMRTLYPGNYPLNQARVDLLLKQNKPKEADKALEALLKSRPDDPDVWYSVAETRGLSGNIIGLHQARAEYFALVGDYRQAIQQLDFAQKLTNNFQLSARLDARKRELMDQERALKEMMN

SEQ ID NO: 4035 - protein, 477 aa, Pseudomonas sp.
MNFLRPTLLTLACLMALPSHADDLPSLGDASSAIVSPQQEHQLGRAWLSLLRGNVNQLNDPQLKDYVETSVYRLAETSQLQDRRLEVILIDSRELNAFAAPGGIVGVNGGLFLNAQTEGEYVSVLAHELAHLSQRHFARGVEAQQRMQLPMMGALLIGIVAAAAGAGDAGIAAIAGTQAAAIQEQRRFSRQNEQEADRIGILNLEKAGYDPRNMPTMFERLMRQYRYDAKPPEFLLTHPVTESRIADTRNRAEQAPKGGTEDSKRYQLIRARVALIYEGTPGLAAKRFQAQLDENPQQDAARYGLALAQIKGGRLNEARENLKPLLAKAPNDITYNLAQIDLDITNNRLPDAQQRVERMRGLYPGNYPLQQARIDLLLKQNRPAEAEKALDALLKNRPQDPDVWYDVAEVRGLSGNTIGLHQARAEYFALVGDFDQALQQLDYAKQRAGNNFVLASKIDARQRELMEQQRMVKDMMR

SEQ ID NO: 4036 - protein, 477 aa, unknown
  environmental sample
MNPLRPALLTLALLMALPGHADDLPSLGDASSAIVSPQQEHQLGRAWLSLLRSQVRQLSDPQLKDYVETSVYRLAETSQLQDRRLEFILIDSRELNAFAAPGGIVGVNGGLFLNAQTEGEYASVLAHELAHLSQRHFARGVEAQQRMQMPMMAALLAGIVLAAAGGGDAGIATIAGTQAAAIQEQRRFSRQNEQEADRIGIQNLEKAGYDPRNMPTMFERLMRQYRFDGKPPEFLLTHPVTESRIADTRNRAEQAPKGGVEDSLRYQLIRARVALTYEGTPGLAAKRFRVQLDENPNLDAARYGLALAQIQGGQLNEARASLKPLLAKAPDDITYNLAQIELEITNNRLDEAEQRIERLRTSYPGNYPLKQARADLLVKLKRPAEAEKVLEDLLKSRSDDPDVWYDMAEVRGLSGNTIGLHQARAEYFALVGDFDQAIQQLDFAKRRAGDNFQLASRIDARQREMLEQERMVKDMMR

SEQ ID NO: 4037 - protein, 478 aa, unknown
  environmental sample
MNFLRPTLLTLACLLATPTLLADDLPSLGDSSSSIVSPEQEHQLGRAWLGMLRSQVGQLSDPQLKDFVETSVYKLAETSQVQDRRLEFILINSNQLNAFAAPGGIIGVNGGLFLYARTEGEYASVMAHELAHLSQRHFARGVEAQQRMQVPIMAAMLAGIVMAAAGAGDAGIATIAGTQAAAIQEQRRFSRQNEQEADRIGILNLEKAGYDPRNMPTMFERLMRQYRFDARPPEFLLTHPVSESRIADTRNRAEQAKPGGQEDSLRYQLMRARVALFYEETPGIAAKRFRAQMAENPNADDARYGLAIAQIKGGQLNEARDGLKPLLDKAPNEVVYNLAQIDLDITSNRLAEARQRADRMLTLYPGNYPLNQARIDVQLKQGRTAEAEKALDALLKRRPADPDVWYQVAEARGLNGNTVGLHEARAEYFALVGDFRQAIQQLDFAKRRSNNNFQVASRIDARQRALAEQERLVKGMMN

SEQ ID NO: 4038 - protein, 435 aa, Pseudomonas sp.
MGRAWLSLLRSQVSQLSDPQLKDYVETSVYKLVETSQVNDRRLEFILINSPQLNAFAAPGGIVGVNGGLFLNAQTEGEYVSVLAHELAHLSQRHFARGVEAQRRMQVPMMAALLAGIVIAATGAGDAGIAAIAGTQAAAIQEQRRFSRQNEQEADRIGILNLEKAGYDPRSMPTMFERLMRQYRFDAKPPEFLLTHPVTESRIADTRNRAEQAKPGGIEDSLRYQLIRARVQLNYEESPGLAAKRFRAQLDENPKNDIARYGLAIAQIKGSQWNEARENLKPLLAKSANDITYNLAQIELDMNSNRLPDAQARVERLLGQYPNNYPLHQIRVDLLLKQNRPADAEKALESLLKSRPDDPDVWYLVAETRGLSGNIIGLHQARAEYFALVGDYGQAIQQLDFAKRRAGSNFPLSSRIDARQREMMDQEQMIKDMMR

SEQ ID NO: 4039 - protein, 478 aa, unknown
  environmental sample
MRFLRPTLLTLACLLAAPGHADDLPMLGDASSAMVTPLQEHQLGRAWLALLRSEVGQLSDPELKEYVESSVYRLAETSQLQDRRLEFILIDSKELNAFAAPGGIVGINGGLFLNAQTEGEYAGVLAHELAHLSQRHFARGMEEQSKVQLPVMAALLAGIVMAAAGAGDAGVATIFGSQAAAIQSQLAFSRQREQEADRIGIINLQKAGYDPRNMPNMFERLMRQYRFDAKPPEFLLTHPITEARIADTRNRAEQFPAGGVEDSLRYQLMRARVQLIYEDTPGMAAKRFRSLLAESPQSDAQRYGLAIAQIKGGQLNEARENLKPLLAKAPNEITYNLAQIALDITNNRLPDAQKRVNQMLDMYPDSYPTNLVSIELLLKENRTADAEKGLEALLKSRPNDPDVWNMVADTRGQNGNIIGLHQARAEYFALTGDFRQAQQQLDFAKRRASDNFQLASRIDARQRELQEQERMVKELMRG

SEQ ID NO: 4040 - protein, 478 aa, Pseudomonas sp.
MSLLRPTLLTLACLLALPVHADDLPSLGDASSAIVSPQQEHDLGRAWLGMLRSQVGQLSDPQLKDYVESTVYRLAESSQLQDHRLEFILIDSKELNAFAAPGGIVGVNGGLFLNADTEGQYAGVMAHELSHLSQRHFARGVEEQKRMQMPVMAALLAGIVLAATGGGEAGIATIMGSQAAAIQSQRAFSRENEAEADRIGLITLQRAGYDPRSMPDMFEKLARQYRFDAKPPEFLLTHPVTEARIADTRNRAEQFPHGGIEDSLRFQLIKKRVELIYEDTPGMAAKRFRALLDENPKSDPARYGLAIAQIKASQFNEAWGNLKPLLAKAPNEIIYNMAAVSLDMANNKLADAQSRVDRLLALYPDNYPLNQVRVDLLIKQNRTADAEKSLEDLLKSRPNDPDVWNQVADTRGANGNIIGLHQARAEYFALEGDFRQAQQQLDFAKRRAANNFQLASRIDARQKDLAEQERMVKELMRG

SEQ ID NO: 4041 - protein, 437 aa, unknown
  environmental sample
MNFLRPTLLTLACLFATHGTADDLPSLGDASSSIVSPEQEHCLGRAWLGLLRGQVAQLSDPQLKDYVETSVYSLAETSQVQDRRLEFILINSPQLNAFAAPGGIIGVNGGLFLNAQTEGEYASVLAHELAHLSQRHFARGIQAQQRMQVPVMAAMLAGIVMAAAGAGDAGIATIAGSQAAAIQEQRRFSRQNEQEADRIGILNLEKAGYDPRNMPTMFERLMRQYRFDARPPEFLLTHPVSESRIADTRNRAEQAKPGGKEDSLLYQLMRARVALIYEETPGIAAKRFRAQLVENPKSDPARYGLAIAQIKGGQLNEARETLKPLLEKAPNDITYNLTQIDLDITNNRLADAQQRVDRMLTLYPGNYPLNDVRIDVLLKQNRTAEAEKSLEALLKTRPDDPDIWYVVAETRGLNGNTIGLHQARAEYFALVGDFRQA

SEQ ID NO: 4042 - protein, 477 aa, Pseudomonas sp.
MNFLRPALLTLACLSASAQAANDLPSLGDASSAIVSPQQEHQLGRAWLSLLRGQVSQLSDPQLKDFVETSVYRLSESSQLNDRRLEFVLLNSPQINAFAAPGGIIGVNGGLFLYAETEAEYASVLAHELAHLSQRHFARGLEAQQRMQLPVMAAMLAGIVAAAAGAGDAGIAAIASTQAAAIQEQRRFSRQNEAEADRIGIINLEKAGYDPKAMPTMFEHLMRQYRYDRMPPEFLLTHPVSESRIADTRNRAEQLPSGGKKDSLEYQLMRARVQLFYEGTPGLAAKRFRAELNENPKNDAARYGLAIALIKGGRQKEAGEILAQLLSKSPKSIPYNLAQVDLDTAASRLSEAQSRLERMLRDYPDNYPLNQARVDLMIRQGRTQDAESKLDALLKSRPKDPDVWYQVAEVRGLSGNRIGLHQARAEYFALVGDYKQAIEQLDYAKRRAANNFQLASRIDARQRELAEEKRMIDEMLN

SEQ ID NO: 4043 - protein, 477 aa, Pseudomonas sp.
MTFLRPTLLTLACLFAGQIGASDLPSLGDASSSIVSPQQEHQLGRAWLGLLRGQVAQLDDPQLKDFVETSVYRLSETSQLQDRRLEFVLLNSPQLNAFAAPGGIIGVNGGLFLYAQTEAEYASVMAHELAHLSQRHFARGVEAQQRMQLPVMAAMLAGIVAAAAGAGDAGMAAIMSTQAAAIQEQRRFSRQNEQEADRIGLLNLEKAGYDPRAMPLMFERLMRQYRYDAKPPEFLLTHPVSESRIADTRNRAEQYPAQGREDSLRYQLMRARVQLTYEETPGVAAKRFRAMLDENPGLDAARYGLALAQMKTGQLGEAGQTLAPLLSKAPEDIVYNLAQIELDMAANRLDAAQRRQERMFALYPSNYPLQQAHIDLLLKQQRTREAERALDELLKNRAKDPDVWYQVAEVRGLSGNTIGLHQARAEFFALVGDYNQAIEQLDFAKRRASNNFQLASRLDARQRELAEEKRLVEQMLR

SEQ ID NO: 4044 - protein, 476 aa, Pseudomonas sp.
MNLLRPTLLALACLALPAGASDLPSLGDASSSIVSPEQEHRLGRAWLSVLRGQIDQLSDPQLKDYVETSVYRLAETSQLEDRRLEFVLLNSPQINAFAAPGGIVGVNGGLLLHAQTEGEYASVMAHELAHLSQRHFARGVEAQQRMQVPVMAAMLAGIVAAAAGAGDAGIATIMGAQAAAIQEQRRFSRQNEQEADRIGLLNLEKAGYDPRAMPSMFERLMRQYRYDSKPPEFLLTHPVTESRIADTRNRAEQYPSQGISDSLGYQLMRARTQLMFEETPGIAAKRFRAMLDSNPRLEAAHYGLAIAHIKGGRLAEARSELNALLTKKPNDLTYNLAMIELDSAANRLSDAQQRIERVRSLYPDSYPLEQARIDLLLKQNQTKEAEVALDQLLKQRSNDPDVWYQVAEVRGLTRNIIGLHQARAEFFALVGDYDQALEQLDLAKRRASSNFPLASRIDARQQELMEEKRALDKMMR

SEQ ID NO: 4045 - protein, 541 aa, Pseudomonas sp.
MHPVRRRTPRGALQRQTSFLSRRTHRITNHVRKGMADKAARIPHSGQHAIEPATVQVLLTRASCMNFLRPTLLTLACLFATHGMADDLPSLGDASSSIVSPEQEHRLGRAWLGLLRGQVAQLSDPQLKDYVETSVYRLAETSQVQDRRLEFILINSPQLNAFAAPGGIIGVNGGLFLNAQTEGEYASVLAHELAHLSQRHFARGMEAQQRMQVPVMAAMLAGIVMAAAGAGDAGIATIAGSQAAAIQEQRRFSRQNEQEADRIGILNLEKAGYDPRNMPTMFERLMRQYRFDARPPEFLLTHPVSESRIADTRNRAEQAKPGGKEDSLLYQLMRARVALIYEETPGIAAKRFRAQLVENPKSDPARYGLAIAQIKGWQLNEARETLKPLLEKTPNDITYNLTQIDLDITNNRLADAQQRVDRMLTLYPGSYPLNDVRIDVLLKQNRTAEAEKSLEALLKTRPDDPDIWYVVAETRGLNGNTIGLHQARAEYFALVGDFRQAIQQLDFAKRRAANNFQLASRIDARQKDLIEQERMVKDMMN

SEQ ID NO: 4046 - protein, 476 aa, Pseudomonas sp.
MKLLRPALLTLACLTALPALANDLPSLGDASSSIVSPEQEHQLGRAWLSLLRGQVSQLSDPQLKDYVESSVYRLAETSQLQDRRLEFVLLDSPQLNAFAAPGGIIGVNGGLFIYAQTEAEYASVMAHELAHLSQRHFARGLEAQQRMQLPLMAAMLAGVVAAAAGAGDAGIAAIVSTQAAAIQAQRRFSRQNEQEADRIGIVNLERAGYDPRAMPSMFGRLMRQYRYDQKPPEFLLTHPVSESRIADTTNRAEQYPQGGAQDSLRYQLMRARTQLKFERTPGVEAKRFRAMLSENPEMDAARYGLALAQVKAGQLDEANSSLAPLLAKAPDDITYNLAQIELDITANRLQQAQTRLQRLLQLYPGNYPVRQMHIDLLMEKGETQQAERELDKLVEQRRQDPDIWYQVAEVRGLSGNIVGLHQARAEYFALVGDYDQGIEQLDLAKRRASNFQIASRIDARQKQLIEEKRMVEEMLR

SEQ ID NO: 4047 - protein, 478 aa, Pseudomonas sp.
MKVLRPALLSLAVAFAMPALADDLPSLGDASSSIVSPEQEFQLGRAWLSMLRNQVDTLNDPQLKDYVESSVYRLAESSELQDHRLAFILIRDKQINAFAAPGGVVGVNGGLFIYAQTEGEYIAVLAHELGHLSQRHFARGIEAQQRMQVPVMAAMLAGIIAAAAGAGDAGIAAIAGTQAAAIQNQLRFSRQNEQEADRVGVATMVRAGYDPRSMPNMFERLARQYRYEGKPPEFLLTHPVTESRIADTRNRAEQYPKGGKEDSLRYELMRARVQQMFEDTPGMASKQFRAQLDEDPKNDAARYGLALSQTKIGQLNDARSNLQQLLAKAPNDISYNLAMSDLDITANKLPDAQARVQKMLGQYPDSYPLIQANADLMMKTNRAADAEKTLFKLSQRRPLDPDVWNRLADACTLSGNAIGVYQARAEYYALTGDYKQAIEQLDFAKRRAGGNFTLAARLDARQQEFREQERILKEMMGR

SEQ ID NO: 4048 - protein, 480 aa, Pseudomonas sp.
MYMKVLRPALLSLACLLAMPTVADDLPSLGDSSSSIVSQEQEFQLGRAWLSMLRNQVDSINDPQIKDFVESSVYRLAETSDLQDHRLAFILIKDPQINAFAAPGGVIGVNGGLFLYAQTEGEYAAVLAHELGHLIQRHFARGLEAQKQMQLPVMAAMLAGIVAAAAGAGDAGIATIASTQAAAIQNQLRFSRQNEQEADRVGVVNMVRAGYDPRSMPTMFERLARQYRYDAKPPEFLLTHPVTDSRIADTRNRAEQYPSSGKEDSLRYQLMRARVQLIFEEMPGMAGKRFRAMLDDNPKLDAARYGLALSQTRIGQLNEARATLQPLLAKAPNELAYNLAQVDLDITANKLNDALSRVQRLLGQYPDSYPLIQAQTDVLMKLNRAADAEKILIKLTQARPLDPDVWSRLADARTIDGNAIGVHQARAEYLALTGDYPSAIEQLDFAKRRAGGNFTLAAKLDARQQEFRDQEKILKEMMRG

SEQ ID NO: 4049 - protein, 579 aa, Pseudomonas sp.
MNFSLKHLAATTLVLAGLSSLTTLAHANISPQQSATILKTFSDASVTDFRQFLGGVVKSDLAKTANLGPAISAFLDNKTLSAEQQNEINRLLGIYARVKYGSAATETLRELVEIPTFQVDGVAQHDNPEFIKIADKIKGLAQAFNLNFRNIDNRVYEISLEGSGDEVVGIHAHADVVPVTPENWVLKDGTKLDPFKVTLIGDRMYGRGTEDDKNGIVVAMYAMKIIKEEKLPLARNFKLLVDTTEETTGDAIPYYFEHNPTPNYNLALDGGYPVVIAEKGYGTVMANFPRRNGQGKGAEIISMTGGMATNQIPSASVATLVTDKPAELAASLQKAGSDYAKRNGGNFEVNAKVDGKDVKLTVTGVSAHSSEPESGVNPVARMLGFIHSVDGKVALKHNHITDAARYAADNWGLDYLGGKLGVGFSDAFMGPLTTSLTFVGMDDKAFKLAVNLRVPKGESPEALKAKIAEKIGAWSKKSHVAATFTYSIAEPMYRNPEGEWVKALLAVSTENLDMEHKFGSSAGATSVHELPNGVQFGLARPEVKYTGHTDNEFKTVDQFLLDLQIVTEMMGRIGQLPKL

SEQ ID NO: 4050 - protein, 579 aa, Pseudomonas sp.
MDFSLKHLAASTLILASLSSFTVAAQTNITPQQSATILKNFSDASASDFRQFLAGVAKSNLAKTADLGPAISAFQDNKTLTPEQQNEIHRLLGLYARVKYGAAATETLRELVAIPTFQVEGVAQHDNPEFIKIADKIKSLAQSFNLNFRNIDNRVYEISLEGSGDEVVGIHAHADVVPVTPENWVLKDGTRLDPFKVTLIGDRMYGRGTEDDKNGIVVALYAMKVIKEEKLPLARNFKLLIDTTEETTGDAIPYYFEHNPTPNYNLALDGGYPVVIAEKGYGTVMGSFARRDGEGQGAEITSMTGGLATNQIPSASVATLVTDKPAELAASLQKAGSEYAKRNGGNFEVSAKVVDKDVKLTVTGVSAHSSEPESGVNPVARMLDFINSLDGKVALKHNHITDAARYAADNWGLDYLGGKLGVGFADDFMGPLTTSLTFVGMNDTTFKLAVNLRVPKGKSPEALKAEIAEKIGAWSKKSHVAATFDYSIAEPMYRNPEGEWVKALLAVASENLGMEHKYGTSAGATSVHELPNGVQFGLARPEVKYTGHTDNEFKTVDQFLLDLQIVTEMMGRIGQLPKL

SEQ ID NO: 4051 - protein, 579 aa, Pseudomonas sp.
MDFSLKHLAATTLMLASLSSFTTAAHANITPEQSATILKTFSDASATDFRQFLTGLAKTDLAKTDGLGAAISAFLDNKSLSADQQNEIHRLLGLYARVKYGSAATETLRELVAIPTFNVDGVAQHDNPEFIKIADKIKSLAQAFNLNFRNIDNRVYEISLDGTGDEVVGIHAHADVVPVTPENWVLEDGTKLDPFKVTLIGDRMYGRGTEDDKNGIVVALYAMKVIKEEKLPLARNFKLLVDTTEETSGDAIPYYFEHNPTPNYNLALDGGYPVVIAEKGYGTVMANFPKRKADGKGAEIVSMTGGLATNQIPSASVVTLLSDKPAELAKSLQKAGAEFAKRNGGNFSVNAKVDGKDVKLTVTGVSAHSSEPESGVNPVSRMLVFINGLDGKVALKHNHITDAARYAADNWGLDYLGGKLGVGFSDAFMGPLTTSLTFVGMDEKAFKLAVNLRVPKGKSPEALKAEIADKIGAWSKKSRVAATFDYSIAEPMYRNPEGEWVKALLAVASENLGMKHEYGTSAGATSVHELPNGVQFGLARPEVKYTGHTDNEFKTVDQFLLDLQIVTEMMGRIGQLPKL

SEQ ID NO: 4052 - protein, 579 aa, Pseudomonas sp.
MDFSLKHLAATTLMLASLSSFTTAAHANITPQQGAAILKTFSDASITDFRQFLTSVAKSDLAKTDDLGTAISAFLDNKSLSADQQNEIHRLLGLYARVKYGSAATETLRELVAIPTFRVDGVAQHDNPEFIKIADKIKSLAQAFNLTFRNVDNRVYEISLEGSGDEVVGIHAHADVVPVTPENWVLKDGTRLDPFKVTLIGDRMYGRGTEDDKNGIVVALYAMKVIKEEKLPLARNFKLLVDTTEETSGDAIPYYFEHNPTPNYNLALDGGYPVVIAEKGYGTVMANFPKRKADGKGAEIVSMTGGLATNQIPSASVATLLSDKPAELAASLQKAGTEYAKRNGDDFEVTAKVVGKDVTLTVTGVSAHSSEPESGINPVARMLVFINSLDGKVALKHNHITDAARYAADNWGLDYLGGKLAVGFSDAFMGPLTTSLTFVGMDENTFKLAVNLRVPKGKSPEMLKREIADKLDAWSKKSQVAVAFDYSIAEPMYRNPEGEWVKALLAVASENLGMEHKFGTSAGATSVHELPNGVQFGLARPEVKYTGHTDNEFKTVDQFLLDLQIVTEMFGRIGQLPKL

SEQ ID NO: 4053 - protein, 579 aa, Pseudomonas sp.
MDFSLKHLAATTLMLASLSSFTTSAHANITPQQSATILKTFSDTSVTDFRQFLGRLAKSDLAHASDLGPAISAFQGNKPLTAEQQNEIHRLLGLYARVKYGNAATETLRELVAIPTFRVDGVAQHDNPEFIKIADKLKGLAQAFNLNFRNIDNRVYEISLAGDGDEVVGIHAHADVVPVTPENWVLKDGTRLDPFKVTLVGDRLYGRGTEDDKNGIVVALYAMKIIKEEKLPLARNFKLLVDTTEETTGDAIPYYFEHNPTPNYNLALDGGYPVVIAEKGYGTVMASFPRRAAEGKGAEITAMTGGLATNQIPSTSVATLVTAKPAELAASLQKAGGDYAKRNGGNFEVSAKVVGKDVKLVVTGVSAHSSEPESGINPVARMLDFINSLDGKVALKHNHMTDAARYAADNWGLDYLGGKLGVGFSDDFMGPLTASLTYVGMDEKAFNLAVNLRVPKGKSPEVLKAEIADKLGTWSKKTHIAAAFDYSIAEPMHRNPEGEWVKALLAVARENLGMEHKFGTSAGATSVHELPNGVQFGLARPEVKYTGHNDNEFKTVDQFLLDLQIVTEMFGRIGQMPKL

SEQ ID NO: 4054 - protein, 579 aa, Pseudomonas sp.
MHSPLKQLAAATLFAASLSAISSPAFANITPDQSTAILKNFNETSVTDFRGFLGALAKGDLGKTSDVGPAISAFLDNKTLSADQQNEINRLLGIYTRVKYGKAATETLRELVEIPTFNVDGVPQYKNPEFIKIAGKIQDLAKAFNLNFRNIDNRVYEISLEGSGDEVVGIHAHADVVPVTPENWVLKDGTKLDPFKVTLIGDRMYGRGTEDDKNGIVVAMYAMKVIKEEKLPLARNFKLLVDTTEETSGDAIPYYFEKNPTPQYNLALDGGYPVVIAEKGYGTVMATFPRRKGEGKGAQIISMTGGMATNQIPSASVATFVTDKPAELAANLQKAGTEYAKRNGGDFEVAAKVDGKDVKLTVTGVSAHSSEPESGVNPVSRMLELIHSVDGKIALKHNHITDAARYASDNWGLDYLGGKLGVGFSDEFMGPLTTSLTFVGLDDKAFKLAVNLRVPKGKSPEKLKAEIADKLSAWDKQSKVKVDFTYSVAEPMYRNPEGEWVKALLAVSTENLGMEHKFGTSAGATSVHELPNGVQFGLARPEVKYTGHTDNEFKTVDQFLLDLQIVTEMMGRIGQLPKL

SEQ ID NO: 4055 - protein, 579 aa, Pseudomonas sp.
MDFSLKQLAAATLMLASLASFTSAAQANITPQQSAVILKSFDDKTVTDFREFLGSLAKSDIAKSENLGPAISAFLDNKTLTAEQLNEVHRLLGIYTRVKYGKAALETLRELVEIPTFQKEGVAQHDNPEFIKIAAKIQSLAESFNLKFRNVDNRVYEISLDGAGNEVVGIHAHADVVPVTPENWVLKDGTKLDPFKVTLIGDRMYGRGTEDDKNGIVVALYAMKVIKEEKLPLARNFKLLVDTTEETTGDAIPYYFENNPTPAYNMALDGGYPVVIAEKGYGTVMAKFAKRTAEGKGAEITSMTGGLATNQIPSASVVTLLTDKPAELAASLQKAGNEFAKHNGGNFEVAAKVDGKDVKLTVTGVSAHSSEPESGVNPVARMLVFINSLNGKVALKHNQFTDAARYAADNWGLDYLGNTLKVGFSDSFMGPLTTSLTYVGEDDKAFKLAVNLRVPKGKSPEKLKAEIADKLSAWTKKTHVAVAFDYSVAEPMYRNPEGEWVKALLAVSTENLGMKHEFGTSAGATSVHELPNGVQFGLARPEVKYTGHTDGEFKTVDQFLLDLQIVTEMMGRIGQLPKL

SEQ ID NO: 4056 - protein, 579 aa, Erwinia sp.
MDFSLKQLAAATLMLASLSAFTTTAYANITPQQNAAILKSFADASVKDFRQFLGTLGKSELAKSANLGPAINAFLDNKTLSAEQQNEIHRLLGLYARVKYGKAATETLRELVAIPTVRVDGVPQHENPEFLKIADKIQALAKAFDLNFRNIDNRVYEISLEGSGKEVVGIHAHADVVPVTPENWVLQDGTKLDPFKVTLVGDRMYGRGTEDDKNGIVVALYAMKIIKEEKLPLARNFKLLVDTTEETSGDAIPYYFERNPTPNYNLALDGGYPVVIAEKGYGTVMASFPRRTAEGKGAEIVSMTGGLATNQIPGASVATLVTDQPAELAASLQKAGSEYAKAHGGDFSVAAKVAGKDVKLTVTGVSAHSSEPESGVNPVARMLDFINSLDGKVALKHNPITDAARYAADNWGLDYLGNKLGVGFADDFMGPLTTSLTYVGQDEQAFKLAVNLRVPKGKTPEVLQQQIADKLAAWSKKNQVAVNFDYKIAEPMYRNPEGEWVKALLAVASENLGMQHQFGTSAGATSVHELPNGVQFGLARPEVKYTGHNDNEFKTVEQFQLDLQIVTEMFGRIGQLPTL

SEQ ID NO: 4057 - protein, 579 aa, Pseudomonas sp.
MVFSLKKLAAATLVMASLTAFTSAAQANITAEQSAAILKSFDGKNLTDFRSFLGSLAQSDLAKTDKLNPSISAFLDNKTLNAEQQNEIHRLLGIYTRVKYGKAALETLRQLVEIPTFRKDGVEQHDNPEFIKIAGEIQKLAESFGLKFRNIDNRVYEISLDGKGDEVVGIHAHADVVPVTPENWVLKDGTKLDPFKVSLIGDRMYGRGTEDDKNAIVVALYAMKVIKDEKLPLARNFKLLVDTTEETSGDAIPYYFERNPTPTYNMALDGGYPVVIAEKGYGTVMANFAKRKGEGNGAEIISMTGGKATNQIPSASVVTLVTDKPGELAASLQKAGDAYAKANGGDFEVAAKVDGKDVKLTVTGVSAHSSEPESGVNPVARMLSFINSLDGKVTLKHNQFTDAARYADDNWGLDYLGKKLGVGFSDSFMGPLTTSLTYVGEDDKTFKLAVNLRVPKGKSPEKLKAEIAEKLDAWSKKTHVAVAFDYSVAEPMYRNPEGEWVKALLAVASENLGMKSEFGTSAGATSVHELPNGVQFGLARPEAKYTGHTDGEFKTVEQFLLDLQIVTEMMGRVGQLPKL

SEQ ID NO: 4058 - protein, 579 aa, Pseudomonas sp.
MNVPFKKLAATTLMLAGLAVFTTPAQANITPQQTAEILKSYNAASVSDFHQFLTELGKSDLAKKAEISPAIGAYLDKKNLTAEQQNEIYRLLGLYTRVKYSAAATETLRELVEIPTYRKDGVEQHDNPEFIKIAAKIKNLAESFGLKFRNIDNRVYEISLDGSGDEVVGIHAHADVVPVTPENWVLKDGTRLDPFKITLIGDRMYGRGTEDDKNGIVVTLYAMKVIKEEKLPLVRNFKLLVDTTEETTGDAIPYYFERNPTPNYNLALDGGYPVVIAEKGYGTVMANFAKRKGEGKGAEIVALTGGMATNQIPSASVATLLTDQPAQLAASLQKAGSEYAKRNGGNFEVSAKVDGENVKLTVTGVSAHSSEPESGVNPVARMLDFINSVDGKVALKHNHITDAARYLADNWGLDYLGNKLGVGFSDAFMGPLTTSPTFVGMDDKTFKLAVNLRVPKGKSPEKLKTEIADKLAAWSKKTHVAVAFDYSVAAPMYRNPEGEWVKALLAVATENLGMKHEFGTSAGATSVHELPNGVQFGLAMPDVKYTGHTDGEFKTVEQFQLDLQIVTEMIGRIGQLPKL

SEQ ID NO: 4059 - protein, 579 aa, Pseudomonas sp.
MDFSLKHLAAATLMLASLSAFTSSAQANITAQQSAAILKTFSDAPAGDFRQFLGALAKSETGKSANLGPAIAAFLDKQSLSAEQQNEIHRLLGIYARVKYGQAATQTLRELVAIPTFNIDGVPQYKNPEFLKIAAKIQDLAKAFNLNFRNVDNRVYEISLEGSGEEVVGIHAHADVVPVTPENWALEDGTRLDPFKVTQIGDRLYGRGTEDDKNGIVVALYAMKIIKEEQLPLARNFKLLVDTTEETSGDAIPYYFEHNPVPQYNLALDGGYPVVIAEKGYGTVMATFARRAAEGKGAEITHLTGGLATNQIPSTSVATLKSDNPAQLAASLQQAGAEYAKAHGGNFQVAAKVAGQDVQLTVTGVSAHSSEPESGVNPVARMLDFINSLDAKVALKHNAFTDAARYLADNWGLDYLGKQLGIGFADDFMGPLTTSPTLVSVDDHVLKLAVNLRVPKGKTPDALKAEITDKLGAWSKKTQVAVKLDTSIAAPMYRNPEGEWVKALLAVASENLGMAHKFGTSAGATSVHELPNGVQFGLARPEVKYTGHTDNEFKTQEQFLLDLQIVTEMMGRIGQLPKL

SEQ ID NO: 4060 - protein, 579 aa, Pseudomonas sp.
MNLSLKKLAASTLILASFSSFASLANATVTAQQSAVILQTFSETSVKDFRQFLNNLASADVVKTADFGPAISAFLDNKQLSASQQNDIHRLLGLYTRMKYGSAATETLRELVAIPTVRVDGVAQHENPAFIKIADTIKRLAEGFNLKFRNVDNRVYEVSLDGAGDEVVGIHVHADVVPVTLDNWVLPDGTRLDPFKVTLIGDRMYGRGTEDDKNGIVAALYAMKVIKEEKLPLARNFKLLIDTTEETAGDAIPYYFERNPTPAYNLALDGGYPVVIAEKGYGTVMASFARRQAEGEGAEIVSMTGGMATNQIPSKSVATLVTDKPAELAASLQQAGAEYVKSNGGDFEVDARVDGKDVKLTVTGVSAHSSAPQSGVNPVARMLDFINSLRGKVALKQNQITDAARYAADNWGLDYLGSKLGVGFSDDFMGPLTASLTYVAMDEKAFKLAVNLRVPKGKSPQVLKSEIAEKLAAWSTKTSIKPVFDYSIAEPMYRNPEGEWVKALLAVASENLGMEHTFGTSAGATSVHSLPNGVQFGLARPEVKYTGHTDNEFKTTGQFLLDLQIVTEMMGRIGQLPKL

SEQ ID NO: 4061 - protein, 579 aa, Pseudomonas sp.
MNLSLKQLAATALIMASLSSFTCVANANVTAQQSTIILKTFGEKSVTDFRQFLKSLSCTDVVKAADFGPAINAFLDNKTLSDAQQNDINRLLGLYTRLKYGNAATDTLRELVAIPTARVDGVAQHENPEFIKIANAIKGLAERFDLKFRNVDNRVYEVSLDGAGDEVVGIHVHADVVPVTPENWVLPDGTRLDPFKVTLIGDRLYGRGTEDDKNGIVVALYAMKVIKEEKLPLARNFKLLIDTTEETTGDAIPYYFERNPTPGYNLALDGSYPVVIAEKGYGTVMASFARRNADGEGAEIVSMTGGAATNQIPSKSVATLLTDKPAQLAASLQQAGADYVKNNGGNFAVDASVDGNDVKLTVTGVSAHSSAPQSGVNPVARMLDFINSLQGKVALRHNQITDAARYAADNWGLDYLGNKLGVGFSDEFMGPLTASLTYVAMDETAFKLAVNLRVPKGRSPEELKSEISEKLAAWSVRTGIKPAFDYSIAKPMYRNPEGEWVRALLAVASENLGMEHAFGTSAGATSVHELPNGVQFGLARPEVKYTGHTDNEFKTTGQFLLDLQIVTEMMARIGQLPKL

SEQ ID NO: 4062 - protein, 559 aa, Pseudomonas sp.
MNFPFKRLAIATLVLSALSSFPISASANITAQQSAEFAKTFGDTSVSDFRQFLASVAKSDLAKTANLGPAINAFQDNKTLSAEQQNEIHRLLGLYARVKYGKAATETLRQLVEIPTYRKDGVAQHENPEFLKIADKIQSLAKDFNLNFRNIDNRVYEISLEGSGDEVVGIHAHADVVPVTPENWVLKDGTRLDPFKVTLVGDRMYGRGTEDDKNGIVVALYAMKIIKEEKLPLARHFKLLVDTTEETTGDAIPYYFERNPTPNYNLALDGSYPVVIAEKGYGTVMAKFPRRAGQGKGAEITALTGGMATNQIPSTSVATFATDNPADLAASLLKAGTDYAKANGGDFEVKSEVAAKTVKLTFTGVSAHSSEPESGVNPVARMLDFINGLDGKVALKHNHITDAARYATDNWGLDYLGKKLGIGFADEFMGPLTASLTYVGMDDKTFKLAVNLRVPVGKPTEALKAEINDKLSAWTKKSKVAVAFDNSIDAPMYRNPEGEWVKALLAVATENLGMEHKFGTSAGATSVHDLPNGVQFGLAMPDVKYTGHNDNEFKTVEQF

SEQ ID NO: 4063 - protein, 601 aa, Pseudomonas sp.
MESILIKRSENSRFACQGMPSIMNLSLKHLAATTLILASLSSFTSLANANVTAQQSAVILKTFNDTSVKDFRQFLTSLSDTEGVKTADFAPAITAFLDNKTLSEAQQNDIHRLLGLYTRLRYGSAATETLRELVAIPTARVDGVAQHENPEFIKIANAIKAIAERFNLKFRNVDNRVYEVSLDGAGDEVVGIHVHADVVPVTPENWVLPDGTRLDPFKVTLIGDRLYGRGTEDDKNGIVVALYAMKVIKEEKLPLARNFKLLIDTTEETTGDAIPYYFERNPTPAYNLALDGSYPVVIAEKGYGTVMASFARRTAEGEGAEIVSMTGGMATNQIPSKSVVTLVTDKPAELAAGLQQAGAEYVKRNGGDFDVDAKVDGNDVKLTVTGVSAHSSSPQSGVNPVARMLGFIDSLQGRVALKHNQITDAARYAADNWGLDYLGSKLGVGFSDDFMGPLTASLTYVAMDEKAFKLAVNLRVPKGRSPEALKSAIAEKLAAWSSKTGIKPAFDYSIAKPMYRNPEGEWVKALLAVASENLDMKHAFGTSAGATSVHELPNGVQFGLARPEVKYTGHTDNEFKTTGQFLLDLQIVTEMMGRIGQLPKL

SEQ ID NO: 4064 - protein, 639 aa, Pseudomonas sp.
MHHFKCPQTGLHICVAFDRQGDRKRLAGSRIHPVRCYFEDVSDHMISYFPHTLRKGMPLAMNLSLKHLAASTLMLASLSAVAPSALANITPQQSAAILKTFNEKSATDFRQFLGSVAKSDLAKTADLEPAISAFLDDKTLTAEQQNEIHRLLGIYARVKYGSAANETLRELVAIPTFAVEGVAQHDNPEFIKIAEKLKTLAESFNLKFRNIDNRVYEVSLEGSSEEVVGIHAHADVVPVTPANWVLPDGTKLDPFKVTLIGDRMYGRGTEDDKNGIVVAMYAMKVIKEEKLPLARNFKLLIDTTEETSGDAIPYYFERNPTPNYNLALDGGYPVVIAEKGYGTVMANFPVRKGEGKGAEITSLTGGAATNQIPSKSVATLVTDKPAELAAELQKAGAEYAKRNGGDFQVDAAVEGKDVKLTVTGVSAHSSDPASGVNPVARILDFINSLDGKVELKHNHITDAAQYAADNWGLDYLGSKLGVGFSDEFMGPLTASLTFVGMDAKTFKLAVNLRVPKGKSPEKLKAEIAEKLTAWSKQSKIAPAFDYSIAEPMYRNPEGEWVKALLAVSTENLGMPHTFGTSAGATSVHNLPNGVQFGLAMPEAKYTGHTDSEFKTTEQFLLDLQIVTEMMGRIGQLPKL

SEQ ID NO: 4065 - protein, 620 aa, Pseudomonas sp.
MVRGERGKQGFSHHCSWCKLKSLLIKRSEHSRFACQGMPSIMNLSLKKLAASTLILASLSSFTSLANATVTAQQSAVILKTFSDTSVKDFRQFLNSLANADVVKTADSGPAISAFLDNKPLSAAQQNDIHRLLGLYTRMKYGSAATETLRELVAIPTVRVDGVAQHENPAFIKIADKIKSLAEGFDLKFRNVDNRVYEVSLDGASDEVVGIHVHADVVPVTLDNWVLPDGTRLDPFKVTLIGDRMYGRGTEDDKNGIVVALYAMKVIKEEKLPLARNFKLLIDTTEETAGDAIPYYFERNPTPAYNLALDGGYPVVIAEKGYGTVMASFARRQAEGEGAEIVSMTGGMATNQIPSKSVATLLTDKPAELAASLQQAGAEYVKSNGGDFEVDARVDGKDVKLTVTGVSAYSSAPQSGVNPVARMLDFINSLQGKVALKHNQITDAARYAADNWGLDYLGSKLGVGFSDDFMGPLTASLTYVAMDEKAFKLAVNLRVPKGKSPQVLKSEIAEKLAAWSTKTAIKPAFDYSIAEPMYRNPEGEWVKALLAVASENLGMEHTFGTSAGATSVHSLPNGVQFGLARPEVKYTGHTDNEFKTTGQFLLDLQIVTEMMGRIGQLPKL

SEQ ID NO: 4066 - protein, 576 aa, unknown
  environmental sample
MHLKKLTATTLLLASIGLFTQPAQANLTHQQSAAIVKAFDGSNPSDFKQFLGKLKGSDLAKADNLEATLDAYLASKPLAAEQQDEINRLLGLYTRIKYGKAATETLRELVAIPTFNVEGTPQYQNPEFLKIADKIKALADSFGLAFRNIDNRVYEISLGSGKEVIGIHAHADVVPVNPDNWKLADGTRLDPFKVTLVGDRMYGRGTEDDKNGIVVAMYALKVAKDENLPLARQFKLLIDTTEETSGDAIPYYFERNPTPDYNLALDGGYPVVIAEKGYGTVMASFSKRAATGKGAEIVNLTGGLATNQIPTTSVATLVSENPTQLAKQLQQAGAKYVKQHGGDFSIDAKAEGKNVLLTVTGVSAHSSEPESGVNPVARMLDFINGVGKQVSLKHNHFTDAARYAADNWGLDYLGNKLGVAFKDAFMGPLTASLTFVGVDDNGLKLAVNLRIPKGKPIATIKDELADKLGKWTRQSHTSVAFDYSLDEPMYRNPEGEWVKALLAVATENLGMKHEFGTSAGATSVHDLPNGVQFGLAMPDVKYTGHNDNEFKTVEQFMLDLQIVSEMVARLGQMPKL

SEQ ID NO: 4067 - protein, 576 aa, Pseudomonas sp.
MHLKKLSALTLLLASIGLFTSQAQANLSQQQSAAILKAYDGSDPADFKQFIGKLASSDLAKADNLGDTLKAYLAGKPLAAEQHNEINRLLGLYTRIKYGKAATDNLRELVAIPTFQVEGVAQHDNPQFHKIADKIKALAESFGLTFRNIDNRVYEITLGEGKEVVGIHAHADVVPVNPDNWKLDDGTHLDPFKVTLVGDRMYGRGTEDDKNGIIVALYAMKVAKDEKLPLARQLKLLVDTTEETTGEAIPYYFERNPVPDYNLALDGGYPVVIAEKGSGAVMATFPRRAASGQGAELTSLTGGLANNQIPTTSVVTLIGDNPADLAARLNKAGAQFVKDNGANFSIEAKVEGKQVLLTSKGVSAHSSEPESGVNPVARMLVFINGLGEQVPLKHNHITDAARYAADNWGLDYTGKKLGIGFEDSFMGPLTASPTFVGLDDKALKLAVNLRVPKGKSVDTLKAELTDKLGAWVKASAVAVSFDTNLDQPMYRNPEGEWVKALLAVASENLGMPHEFGTSAGATSVHDLPNGVQFGLAMPNVKYTGHNDNEFKTVEQFMLDLQIVSEMVARIGQMPKL

SEQ ID NO: 4068 - protein, 576 aa, unknown
  environmental sample
MHLKKLTSVSLLAASIGLFALPAQANLTQQQSAAIVKAFDGSDPHDFKQFLGTLKGSDLARADDLGATLDAYLAGKPLTAEQQNEINRLLGLYTRIKYGKAATQTLRELVAIPTVTVEGTPQHENPEFLKIADKIKALADEFGLAFRNVDNRVYEISLGSGKEVVGIHAHADVVPVTPENWKLADGTRLDPFKVTLVGDRMYGRGTEDDKNGIVVALYALKVAKDENLPLARQFKLLIDTTEETRGDAIPYYFERNPTPDYNLALDGGYPVVIAEKGYGTVMANFAKRAASGQGAEIVNLTGGLATNQIPSTSVATLLTDDASTLAQRLNTAGAEYVKEHGGDFSIAAKPDGKQVVLTVTGVSAHSSEPESGVNPVARMLDFINGVGTTVPLKQNQFTDAARYAADNWGLDYLGKKLGIAYDDAFMGPLTASPTFVGVDDKGLKLAINLRIPKGKAVATIKGEIADKLGKWSQQSHITPAYDYSLDEPMYRNPEGEWVKALLAVASENLGMKHAFGTSAGATSVHDLPNGVQFGLAMPGVKYTGHNDNEFKTVDQFMLDLQVVSEMVARIGQMPQL

SEQ ID NO: 4069 - protein, 662 aa, Serratia sp.
MPLKITRMPRPAVLAVAILCSMTTPALAYDQVYVFGDSLSDTGNNGRFTYDGNKHLLYDEVLAERIGAALVASDDGGYNYAAGGGVAVPALNPADNTQDQVQSYLGRVDGRADGDGLYIHWIGGNDLAAAALNPTTASDVAYNSAAAAAVQVRSLLNAGAGTVIVPTVPNIGSTPQLMELIIQQALTPVQGAAVQAAYATLNSLTTPDNVSRTQAIHQALISAAAQASAIPQVQQAIAAQLIAAFDGLSAQAAQLTDFYNQSEDRLLAQGGGNVVRVDVNKLFAEAIANPAQFGFANTAGMACPAGVSSAVCSSATPGFDASQSYLFSDHFHPSPQAHLLIADYIQAVLDGPAQVVALNQATAAMARDSRATLDSRFQQLRNGDNPQGSLGVFGGYAGQHYDYSANKAAGDGNATTHNLAVGVDYQLAEGWLIGALISGSNDDQQPSSRYEYKARGLLLSAFTALDLFEHGWVNADLHYATMDYDDIRRSMQLGPLTRTETGSTSGKQWGARLTAGYDFPITSYLTTGPMAQFAWDYSNVSGYSEDGNNSTSMRFNDQTYHSQIGALGWRLDSQFGLFNPYAEVSYQHQFGDDVYRAGGGLKSTQTSFTRDSAGQDKNWVDVTLGANMPLTDQVAAFAAVSQTGGLSSGEQFMYNVGVSARF

SEQ ID NO: 4070 - protein, 662 aa, Serratia sp.
MPLKITRMPRPAVLAVAILCSMTAPALAYDQVYVFGDSLSDTGNNGRFTYDGNKHLLYDEVLAQRIGAALVASDDGGYNYAAGGGVAVPALNPADNTQDQVQSYLGRVDGRADGEGLYIHWIGGNDLAAAALNPTTASDVAYNSAAAAAVQVRSLLNAGAGTVIVPTVPNIGSTPQLMELIIQQALTPVQSAAVQAAYATLNSLTTPDNASRTQAIHQALTSAAAQASAIPQVQQAIAAQLIAAFDSLSAQAAQLTDFYNQSEDRLLAQGGGNVVRVDVNKLFAEAIANPAQFGFANTAGMACPAGVSSAVCSSATPGFDASQSYLFSDHFHPSPQAHLLIADYIQAVLDGPAQVVALNQATAAMARDSRATLDSRFQQLRNGDNPQGSLGVFGGYAGQHYDYSANKAVGDGNATTHNLTVGVDYQLAEGWLIGALISGSNDDQQPSSRYEYKARGLLLSAFTALDLFEHGWVNADLHYATMDYDDIRRSMQLGPLTRTETGSTSGKQWGARLTAGYDFPITSYLTTGPMAQFAWDYSNVSGYSEDGNNSTSMRFNDQTYHSQIGALGWRLDSQFGLFNPYAEVSYQHQFGDDVYRAGGGLKSTQTSFTRDSAGQDKNWVDVTLGANMPLTDQVAAFAAVSQTGGLSSGEQFMYNVGVSARF

SEQ ID NO: 4071 - protein, 662 aa, Serratia sp.
MPLKITRMHRPAVLAVAILCSMTTPALAYDQVYVFGDSLSDTGNNGRFTYDGNKHLLYDEVLAQRIGAALVASDDGGYNYAGGGGVAVPALNPADNTQDQVQSYLVRANGRADGDGLYIHWIGGNDLAAAALNPTTASGVAYNSAAAAAVQVRSLLNAGAGTVIVPTVPNIGSTPQLMELIIQQALTPVQGAAVQAAYATLNSLTTPDNASRTQAIHQALTSAAAQASAIPQVQQAIAAQLIAAFDSLSAQAAQLTDFYNQSEDRLLAQGGGNVVRVDVNTLFAEAIANPAQFGFANTAGMACPAGVSSAVCSSAAPGFDASQSYLFSDHFHPSPQAHLLIADYIQAVLDGPAQVVALNQATAAMARDSRATLDSRFQQLRNGDNPQGALGVFGGYAGQHYDYSANKAAGDGNATTHNMTVGVDYQLTEGWLIGALISGSNDDQQPSSRYEYKARGLLLSAFTALDLFEHGWVNADLHYATMDYDDIRRSMQLGPLTRTETGSTSGKQWGARLTAGYDFPITAYLTTGPMAQFAWDYSNVSGYSEDGNSSTSMRFNDQTYHSQIGALGWRLDTQFGLFNPYAEVSYQHQFGDDVYRAGGGLKSTQTSFTRDSASQDKNWVDVTLGANMPLTDQVAAFATVSQTGGLSSGEQFMYNVGVSARF

SEQ ID NO: 4072 - protein, 662 aa, Multievos46 sp.
MPLKITCLPRPAVLAVAILCSMTTPVLAYDQLYVFGDSLSDTGNNGRFTYDSNKHLLYDEVLAQRIGAALVASDDGGNNYAAGGGVAVPALNPADNTQDQVQSYLGQVNGRADGDGLYIHWIGGNDLAAAALNPTTAPGVAYNSAAAAAAQVHSLLNAGAGTVIVPTVPNIGSTPQLMELIIQQALTPVQNAAVQAAYATLNSLATPDNASRTEAIHQALTAAAAQGSAIPQVQQAIAAQLIAAYDSLSAQAAQLTDFYNQSEDHLLAQGGGNIVRVDVNKLFGEAIANPAQFGFTNTAGMACPPGVSSAVCRSTMPGFDSSQAYLFADHFHPSPQAHLLIADYIQAVLDGPAQVVALNQATAAMARDSRATLDSRFQQLRSGENPQGSLGVFGGYAGQHYDYSSNLAAGDGNATTHNLTVGVDYQLTDGWLIGALISGSNDDQQPSSRYDYKARGLLFSAFTALDLFENGWVNADLHYATMNYDDIRRSMQLGALTRTETGSTDGKQWGARITAGYDFPVTSYLTTGPMAQFAWDYSNVSGYSEDGNDSTAMRFNDQTYHSQIGALGWRLDSKFGLFNPYAEVSYQHQFGDDVYRAGGGLKSTQTSFTRDSASQDKNWVDVTLGANMPLTDQVAAFATVSQTGGLSSGEQFMYNVGVSARF

SEQ ID NO: 4073 - protein, 663 aa, Serratia sp.
MPLKIMCMPRPAVLAVAILCSMTTPAQAYDQLYVFGDSLSDTGNNGRFTYDSNKHQLYDEVLAQRIGAALVASDDGGYNYAAGGGVAVPALNPADNTQDQVQSYLNRVNGRADGDGLYIHWIGGNDLAAAALNPTTAPGVAYNSAAAAAAQVHSLLNAGAGTVIVPTVPNIGSTPQLMELIIQQVLTPVQNAAVQAAYATLNSLATPDNASRTQAIHQALTAAAAQGSAIPQVQQAIAAQLIAAFDSLSAQAGQLTDFYNQSEDRLLAQGSGNIVRVDVNKLFSEAIANPAQFGFTNTAGMACPPGVSSAVCSSTMPGFDSSQSYLFADHFHPSPQAHQLIADYIQAVLDGPAQVVALNQATAAMARDSRATLDSRFQQLRSNDNNPQGALGVFGGYAGQHYDYSSNLAAGDGNATTHNLTIGVDYQLTDAWLIGALISGSNDDQQPSSRYEYKARGLLFSAFTSLSVFEHGWVNADLHYATMDYDDIRRSMQLGSLTRTETGSTDGKQWGARVTTGYDFPITSYLTTGPMAQFAWDYSNVSGYSEDGSDSTAMRFNDQTYHSQIGALGWRLDTKFGLFNPYAEVSYQHQFGDDVYRAGGGLKSTQTSFTRDSANQDKNWVDVTVGANMPLTDQVAAFATVSQTGGLSSGEQFMYNVGVSARF

SEQ ID NO: 4074 - protein, 662 aa, Serratia sp.
MPLKITCMPRPAALAVALLCSVTLPVQAYDQLYVFGDSLSDTGNNGRFTYDGSQHLLYDEALAQRIGAALVASDNGGENYAAGGAVAVPGLNPVDNTQDQVQRYLNRVNGQADGDGLYIHWIGGNDLAAAALNAATAPGVAYNSAAAAAAQVHSLLNAGAGTVIVPTVPNIGSTPQLMELIIQQALPPVQGAAIQAAYATLNSVATPDNASRTQAIHAALAAAAKQGSAIPQVQQAIAAQLVAAYDSLSAQAAQLTDFYNQSEDRLLAQGGGNIVRVDVNKLFAEAIANPAQFGFANTAGMACPAGVSSAVCRSDMPGFDAGQSYLFSDHFHPSPQAHLLIADYIQAVLDGPAQVVALNQATAAMARDSRATLDSRFQQLRNGDNPQGSLGVFGGYAGQHYDYADNRAAGDGNATTHNLTVGVDYQLTDSWLIGALIAGSNDDQHPSSRYDYKARGVLLSAFSSLAIFEQGWVNADLHYATMDYDDIRRSMRLGPLTRTETGSTSGKQWGARVTAGYDFPIAAYLTTGPVAQFAWDYSHVSGYSEDGDDSTAMRFNDQTYHSQIGALGWRLDTQFGVFNPYAEVSYQHQFGDDVYRAGGGLKSTQTSFTRDSAGQDKNWVDVTLGANMPLTDRVSAFATVSQTGGLSSGEQFMYNVGVSARF

SEQ ID NO: 4075 - protein, 662 aa, Serratia sp.
MPLKITCMPRPAALAVALLCSVTLPAQAYDQLYVFGDSLSDTGNNGRFTYDGNQHLLYDEALAQRIGAALVASDNGGENYAAGGAVAVPGLNPADNTQDQVQRYLNRVNGQADGDGFYVHWIGGNDLAAAALNAATAPGVAYNSAAAAAAQVHSLLNAGAGTVIVPTVPNIGSTPQLMELIIQQALSPVQGAAIQAAYATLNSVATPDNASRTQAIHAALAAAAKQGSAIPQVQQAIATQLIAAYDSLSAQAAQLTDFYNQSEDRLLAQGGGNIVRVDVNKLFAEAIANPAQFGFANTAGMACPPGVSSAVCSSDMPGFDAGQSYLFSDHFHPSPQAHLLIADYIQAVLDGPAQVVTLNQATAAMARDSRATLDSRFQQLRHGENPQGSLGVFGGYAGQHYDYADNRAAGEGNATTHNLTVGVDYQLTDGWLIGALIAGSNDDQHPSSRFDYKARGLLLSAFSSLAIFEQGWVNADLHYTTMDYDDIRRSLRLGPLTRTETGSTTGRQWGARVTAGYDFPIASYLTTGPVAQFAWDYSRVSGYSEDGDDSTAMRFNDQTYHSQIGALGWRLDTQFGVFNPYAEVSYQHQFGDDVYRAGGGLKSTQTSFTRDSAGQDKNWVDVTLGANMPLTDRVSAFATVSQTGGLSSGEQFMYNVGVSARF

SEQ ID NO: 4076 - protein, 662 aa, Serratia sp.
MPLKKSCALRPAMLAAALAFGLSATARAYDQLYVFGDSLSDTGNNGRFTYDSNQHLLYDEILGQRIGAALIASDNGGYNYAAGGGVAVPALNPADNTQDQVQSYLARVDDRADGEGLYIHWIGGNDLAAAAMNQATAPEVAYTSAAAAASQARALLNAGAGTVIVPTVPNIGSTPQLMELIIQQALGPVQGAAIQAAYAKLNAVTTPDNTSRQEAIHQALSAAAQQGSMNPLAQQAIAAQLIAAFDSFSAQAGQLTDFYNQNEDRLLAQGGGNIVRVDVNKLFSEAIANPGQFGFTNTAGMACPVGVSSAVCHSSMPGFNTEQSYLFADHFHPSPQAHQLIADYIQAVLDGPAQAVALNQATAAFARDSRATLDSRFQQLRTGGNPQGALGVFGGYAGQRYDYSANKIAGDGDATTHNLTVGVDYQLTDDWLIGALLSGSNDDQQPSSHYEYKARGVLFSAFSALTLFEQGWINADLHYASVNYDDIRRSMQLGSLTRTETGDTEGKQWGARVTTGYDFPLTSYLTTGPMAQFAWDYSNVSGYSEHGDDSTAMRFNDQTYRSQIVALGWRLDTQLGLFNPYAEVSYQHQFGDDVYRAGGGLKSTQTSFVLDSAGQDKDWVDVTLGANMPLTERVAAFATISQTGGLSSGEQFMYNVGVSARF

SEQ ID NO: 4077 - protein, 681 aa, Serratia sp.
MVNDNQAAFFSLQALRSRFMPLKIIRAAQPAALAVALAFCLALPAMAYDRVYVFGDSLSDSGNNGRFTYDGSQHLLYDEALAQRIGQALVASDNGGDNYAAGGGVAVPALNPADNTQDQLQRYFSRVNGQADGDGLYIHWIGGNDLAAAALNPATATSVSYHSAAAAAMQVRSLLDAGAGTVVVPTVPNIGSTPQLMELIVQQALAPVQATALQAAYATLNALATPDDAARQQAIHQALSAAAAQGSNNPQVQQVIAAQLIAAYDSLREQAGQLTDFYNSSEDRLLAQGGGNIVRVDVNKLFGEAIANPQQFGFTNTAGMACPAGVSSAVCTGATPGFDNRQSFLFADHFHPSPQAHLLIADYIQAVLDGPAQVVALNQATAAMARDSRATLDSRLQQLRSGDNPTGALGVFGGYAGQHYDYADNATAGDGNATTHNLTVGVDYQLTDGWLIGALIAGSNDDQQPSSRYEYQARGLLFSAFTALELFEHGWINADLHYATLDYDDIRRSMRLGGLTRSETGSTSGKQWGARLTTGYDLPLTSYLTTGPMAQFAWDYSNVSGYSEDGNDSTAMRFDDQTYHSQIGALGWRLDSNFGAFNPYAEISYQHQFGDNVYRAGGGLKSTQTSFTRDAAGQDKNWVDVTVGANLPLGDRVAAFATVSQTGGLSSGEQFMYNVGVSARF

SEQ ID NO: 4078 - protein, 662 aa, Serratia sp.
MPLKIMGAPGRAALAVALVLGLAASAAAAERVYVFGDSLSDSGNNGRYTYDGSQHPLYDEALAQRIGAALLASDLGGDNYAAGGAVAVPALNPADNTQDQVQRYLSQTHGRADANGLYIHWIGGNDLAAAALNPASAPQVSYTSAAAAALQVRSLLDAGAGTVIVPTVPNIGFTPQLMEVIVQQALAPVQNAALQAAYAALNAVATPDAASRQQAIHRALSAAAQQGSSDPQMQQAIAAQLIAAYDSLSAQAGQLTDFYNRSEDQLLAQGGGNIVRADVNRLFGEVIANPQQFGFSNTAGMACPAGVSSAVCRSATPGFNDGQAFLFADHFHPSPQAHLLIADYIQAVLDGPAQAAALTQATAAMARDSRATLDSRFQQLRSGGNPQGALGIFGGYAGQHYDYADNKAAGDGNATTHNLTLGVDYQLTDRWLIGALISGANDDQQPSSRYDYQARGVLFSAFTSLDVFEHGWVNADLHYARLDYDDIRRSVQLGPLTRSETGSTSGKQWGARVTAGYDFPLTSSLSTGPMAQFAWDYSNVSGYSEDGNDSTAMRFNDQTYHSQIGALGWRLDSNLGVINPYAEISYQHQFGDEVYRAGGGLKSTSTSFTRDAAGQDKNWVDVTLGANLPLNDRVAAFATVSQTGGLSSGEQVMYNVGVSARF

SEQ ID NO: 4079 - protein, 667 aa, Yersinia sp.
MPIKIMYPYRMDALAIALFFCATGPTFAYDNVYVFGDSLSDTGNNGRFTYDSNQHYLYDEILAKNAGMTLVASDKGGFNYAAGGAVAVPALNPAYNTQNQVQSYLQRVNGQADSNGLYLHWVGGNDLAAAAASNPASAPSVAYNSAAAAATQVQALLNAGANTVIVPTVPNIGATPMLMELVIQQGLAAVQPSAIPGALQAAFSTLNALTTPDNPSRRQAIHQALTAASERISSIPQVQQGIAVQLIAAFDDQSALAGQLTDFYNNSEDALLAQGSGNIVRVDVNKLFGEIISNPNLFGFTNTAVMPCPIGVSSAVCTSGQAGFAPGQSYLFSDHFHPSPQAHQMIADYMQAVLDAPAQAAALTQATAAMARDTRATLDSRFQQLRTHKNPQDSFGVFGGYAGQHYDYSANIAAGDGNATTHNLTLGIDYQLTENWLIGALIAGSNDNQRPSSRYDYKARGLLLSAFSALEFADYAWMNADVHYASMNYDDIRRSMQIGTLTRTETGNTDGKQWGARFTTGYNIPITTYLTTGPMAQFALDYSNVSGYSENGNDSTAMRFSDQTYHSQIGSLGWRLDGKFSLFNPYAEVNYQHQFGDDVYRSGGGLKSTQTHFVRDSARQDKNWVNLTLGANVPLTDNVASFASISQTTGLSSGEQFMYNIGLSARF

SEQ ID NO: 4080 - protein, 653 aa, Yersinia sp.
MAALAATLSFCITPSSFAYGQLYVFGDSLSDTGNNGKFTYDSSTHLLYDEVLAQHIGANLIPSNIGGFNYATSGAVATPALNATNNTQDQVQNYLNQVNGKADSNGLYIHWIGGNDLAAAATLNPAASQTVAYTSAAAAAMQVHSLLNAGAGTVIVPTVPNIGSTPMLMELVIQQGLTSVQNAAVQAAYATLNSLATPDNTSHQQAIHQALTAAAGQASIIPPVQQAIAAQLIDAYDKLSTQAEQLTNFFNSSEDHLLAQSGGNIVRVDVNKLFAEVIANPRQFGFTNTVGMPCPPGVSSAVCSATQTGFDHSQSYLFADNFHPSPQAHLLVADYMQAVLDGPTQAVALTQATAAIARDSRATLDSRFQQLRIGKNPQNTLGIFGGYAGQHYDYSANLTAGNGNATTHNLSVGVDYQLTSRWLIGALISGSNDNQQPSTRYDYKARGLLFSAFTALNIVDHGWINADLHYATMNYDDIQRSMQLGPMTRTENGNTDGKQWGARLTVGYDIPITPYLTTGPITQFSLDYSNVSGYSEQGSSSTAMHFNDQTYHSQIGALGWRLDGQFSQFAPYAEVLYQHQFGDDVYRAGGGLKSTQTQFVRNTAKQDNNWLDITLGASLPLTDRLTAFASISQTGNLSSGEQLRYNIGVSALF

SEQ ID NO: 4081 - protein, 663 aa, Yersinia sp.
MSSKTSYAARMATLAATLSFCVIPLSFAYDQLYVFGDSLSDTGNNGKFTYDSSTHLLYDEVLAQHIGTNLLPSSHGGFNYATSGAVANPALNATHNTQDQVQNYLNRVNGKADSNGLYIHWIGGNDLAAAATLNPAASQTVAYTSAVAAAMQVNSLLNAGAGTVIVPTVPNIGSTPMLMELVIQQGLSAVQNAAVQAAYTTQNSLATPDNTSHQQAIHQALTAAAEQASIVPSVQHAIAAQLIDAYDKLSTQAEKLTEFFNSSEDHQLAQNGGNIVRADVNRLFAEVIANPRQFGFTNTVGMPCPPGVSSAVCSATQVGFNDSQSYLFADNFHPSPQAHLLVADYMQAVLDGPTQVVALTQATAAIARDTRATLDSRFQQLRTGKNPPNALGIFGGYAGQRYDYSANLTAGNGHATTHNLSVGVDYQLTNRWLIGALISGSNDNQKPSTRYDYSARGFLFSAFTALDILDHGWVNADLHYATMNYDDIQRSMQLGPLTRTENGDTHGKQWGARLTAGYDIPITPYLTTGPITQFSLDYSNVSGYSEQSNSSTAMHFNDQTYHSQIGAIGWRLSGQFSHFSPYAEVLYQHQFGDDVYRAGGGLKSTQTQFVRNTAKQDNNWLDMTLGASLPLTDQLTAFASISQTGNLSSGEQFRYNIGFSALF

SEQ ID NO: 4082 - protein, 370 aa, Serratia sp.
MSATLKRLTFGMLLLCAFGAAAACEWPAWQQYKQFYISDEGRVIDPSSPNRITTSEGQSYGLFFALVANDRPTFDKLLEWTENNLAAGDLSAHLPAWLWGEDDKKRWTVLDTNTASDADLWIAYNLLEAGRLWKSRRYQTLGTLLLQRIGREEVADIPGLGLMLLPGKVGFVAQDRWRLNPSYLPPQLLARFAALNGPWRAMQKTNQRLLLETAPHGFSPDWVVWQAGKGWQPDTVKPDVGSYDAIRVYLWIGMLADDDEHKAALVKQLLPMAQSTAQQGVPPEKTDTASGKTSGDGPVGFSAVMLPMLANQTAALDVQRQRINQHPPGDDAYFSASLTLFGQGWDQQRYRFNRQGELQPAWGGQCVTSK

SEQ ID NO: 4083 - protein, 359 aa, Serratia sp.
MLLLCAFGAAAACEWPAWQQYKQFYISDEGRVIDPSSPNRITTSEGQSYGLFFALVANDRPTFDKLLEWTENNLAAGDLSAHLPAWLWGEDDKKRWTVLDTNTASDADLWIAYNLLEAGRLWKSRRYQTLGTLLLQRIGREEVADIPGLGLMLLPGKIGFVAQDRWRLNPSYLPPQLLARFAALNGPWRAMQKTNQRLLLETAPHGFSPDWVVWQAGKGWQPDTVKPDVGSYDAIRVYLWVGMLADDDEHKAALVKQLLPMAQLTAQQGVPPEKTDTASGKTSGDGPVGFSAVMLPMLANQTAALDVQRQRINQHPPGDDAYFSASLTLFGQGWDQQRYRFNRQGELQPAWGGQCVTSK

SEQ ID NO: 4084 - protein, 370 aa, Serratia sp.
MFATLKRLTFGMLLLCAFSAAAACEWPAWQQYKQFYISEEGRVIDPSSPNRITTSEGQSYGLFFALVANDRPTFDKLLEWTENNLAAGDLSAHLPAWLWGEDDKKRWTVLDTNTASDADLWIAYNLLEASRLWKSRRYQTLGTLLLQRIGREEVADIPGLGLMLLPGKVGFVAEDRWRLNPSYLPPQLLARFAALNGPWRAMQQTNQRLLLETAPHGFSPDWAVWQAGKGWQADTVKPDVGSYDAIRVYLWAGMLADDDEHKAALIKQLLPMAQLTAQQGVPPEKADTASGKTSGDGPVGFSAAMLPMLANQTAALDAQRQRINQHPPGDDAYFSASLTLFGQGWDQQRYRFNRQGELQPAWGGQCVTSK

SEQ ID NO: 4085 - protein, 370 aa, Serratia sp.
MPVALKRLTFGMLLLCAFSAAAACEWPAWQQYKQFYISEQGRVIDPSSPNRITTSEGQSYGMFFALVANDRPAFDQLLEWTENNLAAGDLSAHLPAWLWGENDKKQWTVLDSNSASDADLWIAYNLLEAGRLWNSRRYQTLGTLLLQRIAREEVADIPGLGLMLLPGKVGFVAEDRWRLNPSYLPPQLLARFSALNGPWRAMEQTNLRLWLETAPHGFSPDWVVWQVGKGWQPDTVKPNIGSYDAIRVYLWAGMLADDDKQKAALLKQLQPMAQTTLTQGVPPEKTDTASGKTSGDGPVGFSASMLPMLVNQPEALQVQRQRIKQNPPGDNAYFSASLVLFGQGWDQQRYRFNRQGELQPSWGGQCVTSE

SEQ ID NO: 4086 - protein, 370 aa, Serratia sp.
MNAMLQRLSLGMLLLCAFSAAAACEWPGWQQYKQFYISPQGRVIDPSSPNKITTSEGQSYGLFFALVANDRPTFDLLLTWTENNLAAGDLSARLPAWLWGESDDKQWKVLDANSASDADLWIAYNLLEAGRLWKSRRYQTLGTLLLQRIGREEVADIPGLGLMLLPGKVGFVAEDRWRLNPSYLPPQLLARFAALNGPWRAMREINQRLWLDTAPHGFSPDWVVWRVGAGWQPDTVKPNVGSYDAIRVYLWAGMLADDDEHKAALLERFQPMAQLTAKQGVPPEKTDTASGKTTGDGPVGFSASMLPMLATQAEALAVQRQRISEHPPGDDAYFSASLTLFGQGWDQQRYRFNRQGELQPSWDGQCTTSK

SEQ ID NO: 4087 - protein, 373 aa, Serratia sp.
MTAVNAMLQRLSLGMLLLCAFSAAAACEWPGWQQYKQFYISPQGRVIDPSSPNKITTSEGQSYGLFFALVANDRPTFDQLLTWTENNLAAGDLSARLPAWLWGEGDDKQWKVLDANSASDADLWIAYNLLEAGRLWKSRRYQTLGTLLLQRIGREEVADIPGLGLMLLPGKVGFVAEDRWRLNPSYLPPQLLTRFAALNGPWRAMREINQRLWLETAPHGFSPDWVVWRVGAGWQPDTVKPNVGSYDAIRVYLWAGMLADDDEHKAALLKRFQPMAQLTASQGVPPEKTDTASGKTTGDGPVGFSAAMLPMLAAQADALAAQRQRIGEHPPGDDAYFSASLTLFGQGWDQQRYRFNRQGELQPSWDGQCTTSK

SEQ ID NO: 4088 - protein, 373 aa, Serratia sp.
MTAVNAMLQRLSLGMLLLCAFSAAAACEWPGWQQYKQFYISPQGRVIDPSSPNKITTSEGQSYGLFFALVANDRPAFDLLLTWTENNLAAGDLGARLPAWLWGESDDKQWKVLDANSASDADLWIAYNLLEAGRLWKSRRYQTLGTLLLQRIGREEVADIPGLGLMLLPGKVGFVAEDRWRLNPSYLPPQLLARFAALNGPWRAMREVNQRLWLDTAPHGFSPDWVVWRVGAGWQPDTVKPNVGSYDAIRVYLWAGMLADDDEHKAALLERFQPMAQFTAKQGVPPEKTDTASGKTTGDGPVGFSASVLPMLATQAEALAVQRQRISEHPPGDDAYFSASLTLFGQGWDQQRYRFNRQGELQPSWDGQCTTSK

SEQ ID NO: 4089 - protein, 367 aa, Serratia sp.
MLQRLSLGMLLLCAFSTAAACEWPGWQQYKQFYISPQGRVIDPSSPNKITTSEGQSYGLFFALVANDRPTFDLLLTWTENNLAAGDLSARLPAWLWGESDDKQWKVLDANSASDADLWIAYNLLEAGRLWKSRRYQTLGTLLLQRIGREEVADIPGLGLMLLPGKVGFVTDDRWRLNPSYLPPQLLARFAALNGPWRAMRQVNQRLWLDTAPHGFSPDWVVWRVGAGWQPDPVKPNVGSYDAIRVYLWAGMLADDDEYKAALLERFQPMAQLTTKQGVPPEKTDTASGKTTGGGPVGFSASMLPMLATQAEALATQRQRISEHPPGDDAYFSASLTLFGQGWDQQRYRFNRQGELQPSWDGQCTTSK

SEQ ID NO: 4090 - protein, 371 aa, Serratia sp.
MMGICLRRLLPGLMLLCAFSTAASCDWPAWQQYQRFYLSEEGRVIDPSSPKRITTSEGQSYGMFFALVANDRPAFDKLLAWTENNLASGDLSAHLPAWLWGQDDNKAWKVLDSNSAADADLWIAYNLLEAGRLWQSRRYQTLGTLLLQRIGREEVANIPGLGLMLLPGKMGFVAEDRWRLNPSYLPPQLLARFAQLNGPWRAMQKTSQRLLLETAPQGFSPDWAEWQAGKGWQPDPVKPDVGSYDAIRVYLWAGMLADDDPHKAALMKQFQPMVRLTAQLGAVPETVDTASGKANGTGPVGFSAAMLPLLAAQPDALAVQRQRIQDNPLGNDAYFSASLLLFGQGWDQQRYRFNRQGELQPAWSSQCATSH

SEQ ID NO: 4091 - protein, 371 aa, Serratia sp.
MMRNCLRRLLPGLMLLCAFSTAASCDWPAWQQYQQFYLSEEGRVIDPSSPKRITTSEGQSYGMFFALVANDRPAFDKLLAWTENNLASGDLSAHLPAWLWGQDDNKAWKVLDSNSAADADLWIAYNLLEAGRLWQSRRYQTLGTLLLQRIGREEVANIPALGLMLLPGKMGFVAEDRWRLNPSYLPPQLLARFAQLNGPWRAMQKTSQRLLLETAPQGFSPDWAEWQTGKGWQPDPVKPDVGSYDAIRVYLWAGMLADDDPHKAALMKQFQPMVRLTAQLGAVPETVDTASGKANGTGPVGFSAAMLPLLAAQPDALAVQRQRIQDNPLGNDAYFSASLLLFGQGWDQQRYRFNRQGELQPAWSSQCATSH

SEQ ID NO: 4092 - protein, 369 aa, Serratia sp.
MGVLLKYSLSLLLLCAFGAAAGCDWPAWQRYKQDYISAGGRVIDPSTPNRITTSEGQSYGLFFALVAGDRPAFDRLLSWTEDNLAQGDLSARLPAWLWGENENKQWTVLDDNSASDSDLWIAYSLLEAGRLWDSRRYQTLGTLLLQRIAREEVADIPGLGPMLLPGKVGFVKDDGWRLNPSYLPPQLLARFAALRGPWRAMQQSNQRLWLETAPHGFSPDWVVWRKTQGWRADAAKPNVGSYDAIRVYLWAGMLADDDAHKAALVRRFQPMAQLTAQQGVPPEKTDTASGKTSGNGPVGFSAALLPLLAHQPEALAAQRQKIIDHPPGNDAYFSASLTLFGQGWDEQRYRFNRQGELQPSWDRQCATSE

SEQ ID NO: 4093 - protein, 369 aa, Serratia sp.
MGVLLKYSLSLLLLCAFGAAAGCDWPAWQRYKQDYISAGGRVIDPSTPNRITTSEGQSYGLFFALVAGDRPAFDRLLSWTEDNLAQGDLSARLPAWLWGENENKQWTVLDDNSASDSDLWIAYSLLEAGRLWDSRRYQTLGTLLLARIAREEVADIPGLGPMLLPGKVGFVKDDGWRLNPSYLPPQLLARFAALRGPWQAMQQSNQRLWLETAPHGFSPDWVVWRKTQGWRADAAKPNVGSYDAIRVYLWAGMLADDDTLKAALVRRFQPMAQLTAQQGVPPEKTDTASGKTSGNGPVGFSAALLPLLAHQPEALAAQRQKIIDHPPGNDAYFSASLTLFGQGWDEQRYRFNRQGELQPSWDRQCATSE

SEQ ID NO: 4094 - protein, 363 aa, Serratia sp.
MDLDPAAAVRVQRHGGLPVAGMAAVPAVLHQRGGRVIDPSSPNRITTSEGQSYGLFFALVANDRPTFDRLLNWTENNLAKGDLGAHLPAWLWGEDDKQRWLVLDDNSASDADLWIAYSLLEAGRLWQSRRYLTLGTLLLQRIAREEVADIPGLGPMLLPGKMGFVDDPRWRLNPSYLPPQLLARFASLNGPWQAMQQVNQRMLLETAPHGFSPDWVVWQRDKGWQADGAKPNIGSYDAIRVYLWAGMLASGDPLRTALRERFLPMTQLTARQGVPPEKTDTAAGTTRGDGPVGFAAALLPLLADQPDALARQRQRVNDNPPGDDAYFSASLTLFGQGWDQQRYRFTRQGELQPAWGSQCTTSE

SEQ ID NO: 4095 - protein, 372 aa, Serratia sp.
MAMTGGCLQRLLYGVLLLCAVNTATACEWPAWQQYRQFYISDDGRVIDPSSPNLVTTSEGQSYAMFFALVANDRATFDKLLKWTENNLSAGSLTAHLPAWLWGKNDQNHWQVLDSNSASDADLWLAYDLLEAGRLWKNHHYQRVGRLLLQRIGREEVVDIPDLGKMLLPGKVGFVAEERWRLNPSYLPPQLLARFARFNGPWKAMKKSNQRLLLETAPQGFSPDWVIWQADKGWQADEVNPNMGSYNAIRVYLWAGMLADEDPHKVALVKQFQPMVQMTTQLGVPPEETDTATGKTTGYGPVGFSAALLPLLATQPAVLAQQRQRLADPLPSDAYFSASLILFGQGWDQQRYRFNRQGELLPSWGSKCVTTD

SEQ ID NO: 4096 - protein, 377 aa, Yersinia sp.
MPMVVMFKRLVCTMLLLASFGSAAACEWPAWQQFKHAYISDSGRVIDPSSPQKITTSEGQSYGLFFALVANDRPTFDRLLNWTENNLAAGDLTASLPAWLWGQNPQHHWGVLDPNSASDADLWIAYNLLEAGRLWDSRRYQTMGTLLLQRIAKEEVVSIPGLGKMLLPGKIGFNGSDHWRLNPSYLPPQLLARFASLTGPWKAMIDVNQRLWLETAPRGFAPDWVVWQKGKGWQPDEMKPNVGSYDAIRSYLWAGMLSDNSPQKAALIKRFQPMAAMTQQQGLPPEKTDTNTGKTRGNGPVGFSAALLPFLASSPTPFDKQTLALQQQRVQDSPPGDDAYYSAVLTLFGQGWSQNRYRFNRLGELQPSWNGRCATLK

SEQ ID NO: 4097 - protein, 371 aa, Pectobacterium sp.
MPRVLRYLTPTLLWLWASLATAAVCDWPAWEQYKQYYISEEGRVIDTSTPNKITTSEGQSYALFFALVANDRVMFDRLLKWTEDNLSAGDLHANLPAWLWGENTDKQWTVLDPNSASDADLWIAYSLLEAGRLWKETRYQTLGTALLARIAKEEVVTIPGLGVMLLPGKVGFAEKESWRLNPSYLPPQLLARFAPLDEKWKAMQRTTQRLLLETAPKGFSPDWVIWQKGKGWQPDTTKPNVGSYDAIRVYLWAGMMADSSRGKTDLLKQFQPMVQQTIRQGLPPEKADTATGTVTGQGSVGFSASLLPMLSRQPDALAAQRQRLAANPPGDDAYFSASLTLFGQGWDQKRYRFTSQGQLLPSRGSQCTTTP

SEQ ID NO: 4098 - protein, 250 aa, Serratia sp.
MKKRFSLLAGMLFALTMPAHAAENTEAKAIGPKHGATLIPKARQVICEHDGGYNHPDDGSNIPNAACRNAFLYKAETIPIWERRQMFTEWPAYSQNLQGTQHPSDKVPDGQLCSAGIAKFEGIDQPHADWYVSSVSVKDGQATLYFDATQVHEPSKWTVSLAKPSFNAATDKLKWSDLTPLEVTKVTVPPPAKGNHVKYAGVYQIEVKIPADRADGKQTLLYVQWERQDPARETFFSCSDVRFNGESAAK

SEQ ID NO: 4099 - protein, 250 aa, Serratia sp.
MKKRFSLLAGMLFALTMPAHAAENTESKAIGPKHGATLIPKARQVICEQDGGYNHPDDGSNIPNAACRNAFLYKAETIPIWERRQMFTEWPAYSQNLQGTQHPSDKVPDGQLCSAGIARFEGIDQPHADWQVSSVSVKDGQATLYFDATQVHEPSKWTVSLAKPSFNAATDKLKWSDLTPLEVTKVIVPPPAKGNHVKYAGVYQIDVKIPADRADGKQALLYVQWERLDPARETFFSCSDVRFNGVSAAK

SEQ ID NO: 4100 - protein, 733 aa, Serratia sp.
MRLSTLVLAIGMALSAQAQAAETNPHASHSALPSGQAKEANVTGEANQHENKKNENPFFYQSRLPFQAPPFNLIKESDYAPAIDAGIKQKLEEVEKIANNPAKPDFKNTFVALEQAGALLTRVMNVFGAMTSANTSDALQKLDEESSPKLAALEDAIMLNSKLFARIKAIYQQRDALKLDAESRRLVEVTYKNFELAGANLSDADKTRLKALNQEAATLSTQFSNKLLAATKDGALAIADKGKLDGLSESELAAAAQAAGERKLDKQWLLVLQNTTQQPELQSLKDRDTRKALFDASWNRAEKGDGNDTRQTIARLAKVRAEQAKLLGFPNYAAWKLQNQMAKTPDAALSFMRNIVPAATARAEREAKDIQAVIAQQKGDFKVAAWDWQFYAEQVRKAKYDLDESQIKPYFELDNVLNNGVFYAANLLYGISFKERKDIPVYQPDVRVYEVFDKDGKSLALFYTDFFKRDNKGGGAWMSNFVEQSKLKGTKPVIYNVANFTKPAPGQPALLSYDDVITLFHEFGHALHGMFADQEYPSLSGTNTARDFVEFPSQFNEHWARDPKVFAHFAKHYKTGEAMPQELVDKIKKADKFNKGYDMTELLSAALLDMHWHMLSADQPQQDVDKFEAESLLKDKIDLSYVPPRYRSSYFKHIWGNGYAAGYYAYLWTEMLADDAFQWFTEHGGLTAENGQRFRDRVLSRGNSQDLEKLYVDWRGKEPSIEPMLINRGLKDE

SEQ ID NO: 4101 - protein, 733 aa, Serratia sp.
MRLSTLVLAIGMVLTSQAQAAETNPHASHSALPSGQAKEANVTGEANQHENKKNENPFFYQSRLPFQAPPFNLIKESDYAPAIDAGIKQKLEEVEKIANNPAKPDFKNTFVALEQAGALLTRVMNVFGAMTSANTSDTLQKLDEESSPKLAALEDAIMLNSKLFARIKAIYQQRDALKLDAESRRLVEVTYKNFELAGANLSDADKTRLKALNQEAATLSTQFSNKLLAATKDGALAIADKGKLDGLSESELAAATQAAGERKLDKQWLLVLQNTTQQPDLQSLKDRDTRKALFDASWSRAEKGDGNDTRQTIARLAKVRAEQAKLLGFPNYAAWKLQNQMAKTPDAALSFMRNIVPAATARAEREAKDIQAVIDQQKGDFKVEAWDWQFYAEQVRKAKYDLDESQIKPYFELDNVLNNGVFYAANLLYGISFKERKDIPVYQPDVRVYEVFDKDGKSLALFYTDFFKRDNKGGGAWMSNFVEQSKLKGTKPVIYNVANFTKPAPGQPALLSYDDVITLFHEFGHALHGMFADQEYPSLSGTNTARDFVEFPSQFNEHWASDPKVFAHFAKHYKTGEAMPQALVDKIKKADKFNKGYDMTELLSAALLDMHWHMLSADQPQQDVDKFEAESLLKDKIDLSYVPPRYRSSYFKHIWGNGYAAGYYAYLWTEMLADDAFQWFTEHGGLTAENGQRFRDRVLSRGNSQDLEKLYVDWRGKEPSIEPMLINRGLKDE

SEQ ID NO: 4102 - protein, 733 aa, Multievos46 sp.
MRLSTLVLAIGMALSSQAQAAETNPHADHTALPSGQAKEANVTGEANQHNNKKNQNPFFYQSRLPFQAPPFNLIKESDYAPAIDAGIKQKLEEVEKIANNPAKPDFKNTFVALEQSGALLSRVMNVFGAMTSANTSDALQKLDEESSPKLAALDDAIMLNSKLFARIKTIYQQRDALKLDAESRRLVEVTYKNFELAGANLSDADKTKLKALNQEAATLSTQFSNKLLAATKDGALAIADKGKLDGLSESELAAAAQAAGERKLDKQWLLVLQNTTQQPDLQSLKNRDTRKALFDASWNRAEKGDGNDTRQTIARLAKVRAEQAKLLGFPNYAAWKLQNQMAKTPDAALSFMRNIVPAATARAEREAKDIQAASDQQKGDFKVAAWDWQFYAEQVRKAKYDLDESQIKPYFELDNVLNNGVFYAANLLYGISFKERKDIPVYQPDVRVYEVFDKDGKSMALFYTDFFKRDNKGGGAWMSNFVEQSKLKGTKPVIYNVANFTKPAPGQPALLSYDDVITMFHEFGHALHGMFADQEYPSLSGTNTARDFVEFPSQFNEHWASDPKVFAHYAKHYKTGEAMPQELVDKIKKADKFNKGYDMTELLSAALLDMHWHMLSADQPQQDVDKFEAESLMKDKIDLSYVPPRYRSSYFKHIWGNGYAAGYYAYLWTEMLADDAFQWFSEHGGLTAENGQRFRDMVLSRGNSQDLEKLYVEWRGKEPSIEPMLINRGLKDE

SEQ ID NO: 4103 - protein, 733 aa, Serratia sp.
MRLSTLVLAIGMALGTQAQAAETNPHADHSALPSGQAKEATVTGEANQHDNKKNQNPFFYQSRLPFQAPPFNLIKESDYAPAIDAGIKQKLEEIEKIANNPAKPDFKNTFVAMEQSGALLSRVMNVFGAMTSANTSDGLQKLDEQSSPKLAALDDAIMLNSKLFARIKAVYQQRDALKLDAESRRLVEVTYKNFELAGANLSDADKTKLKALNQEAATLSTQFSNKLLAATKDGALAIADKGKLDGLSEGELAAAAQAAGERKLDKQWLLVLQNTTQQPELQSLKDRETRKALFDASWNRAEKGDANDTRQTIARLAKVRAEQAKLLGFPNYAAWKLQNQMAKTPDAALSFMRNIVPAATARAEREAKDIQAVIGQQKGGFKVEAWDWQFYAEQVRKAKYDLDESQIKPYFELDNVLNNGVFYAANLLYGISFKERKDIPVYQPDVRVYEVFDKDGKSLALFYTDFFKRDNKGGGAWMSNFVEQSKLKGTKPVIYNVANFTKPAPGQPALLSYDDVITMFHEFGHALHGMFADQEYPSLSGTNTARDFVEFPSQFNEHWASDPKVFAHFAKHYKTGEAMPQELVDKIKKADKFNKGYDMTELLSAALLDMHWHMLSADQPQQDVDKFEAESLMKDKIDLSYVPPRYRSSYFKHIWGNGYAAGYYAYLWTEMLADDAFQWFTEHGGLTAENGQRFRNMILSRGNSQDLEKLYIDWRGKEPSIEPMLINRGLKDE

SEQ ID NO: 4104 - protein, 733 aa, Serratia sp.
MRLSTLVLAIGMALGTQAQAAETNPHADHSALPSGQAKEATVTGEANQHDNKKNQNPFFYQSRLPFQAPPFNLIKESDYAPAIDAGIKQKLEEIEKIANNPAKPDFKNTFVAMEQSGALLSRVMNVFGAMTSANTSDGLQKLDEQSSPKLAALDDAIMLNSKLFARIKAVYQQRDELKLDAESRRLVEVTYKNFELAGANLSDADKTKLKALNQEAATLSTQFSNKLLAATKDGALAIADKGNLDGLSESELAAAAQAAGERKLDKQWLLVLQNTTQQPELQSLKNRETRKALFDASWNRAEKGDANDTRQTIARLAKVRAEQAKLLGFPNYAAWKLQNQMAKTPDAALSFMRNIVPAATARAEREAKDIQAVIDQQKGNFKVEAWDWQFYAEQVRKAKYDLDESQIKPYFELDNVLNNGVFYAANLLYGISFKERKDIPVYQPDVRVYEVFDKDGKSLALFYTDFFKRDNKGGGAWMSNFVEQSKLKGTKPVIYNVANFTKPAPGQPALLSYDDVITMFHEFGHALHGMFADQEYPSLSGTNTARDFVEFPSQFNEHWASDPKVFAHFAKHYKTGEAMPQELVDKIKKADKFNKGYDMTELLSAALLDMHWHMLSADQPQQDVDKFEAESLMKDKIDLSYVPPRYRSSYFKHIWGNGYAAGYYAYLWTEMLADDAFQWFTEHGGLTAENGQRFRNMILSRGNSQDLEKLYIDWRGKEPSIEPMLINRGLKDE

SEQ ID NO: 4105 - protein, 733 aa, Serratia sp.
MRLSTLVLAIGMALGSQAQAAETQPHADHSALPSGQAKEATVTGEANQHDKQKTQNPFFYQSRLPFQAPPFNLIKESDYAPAIEAGIKQKREEVEKIANNPAKPNFKNTFVALEQAGSLLTRVMNVFGAMTSANTSDALQKLDEETSPKLAALNDDIMLNGKLFARIKAIYQDRDALKLDPESRRLVEVTYKNFELAGANLSDADKTKLKALNQEAATLSTQFTNKLLAASKNGALAITDQAKLDGLSEGELAAAAQAAAERKLEKQWLLVLQNTTQQPLLQSLKDRDTRKALFDASWTRAEKGDGNDTRQTISRLAKVRAEQAKLLGYPNYAAWKLQNQMAKTPDAALSFMRNIVPAATARAEREAKDIQAVIDQQKGDFKVQAWDWQFYAEQVRKAKYDLDESQIKPYFELNNVLNNGVFYAANLLYGISFKERKDIPVYQPDVKVYEVFDKDGKSLALFYTDYFKRDNKGGGAWMSNFVDQSKLNGTKPVIYNVANFTKPAPGQPALLSYDDVITMFHEFGHALHGMFADQEYPSLSGTNTARDFVEFPSQFNEHWVSDPKVFSHFAKHYQTGEAMPQELVDKIKKADKFNKGYSMTELLSAALLDMHWHMLTADQPQQDVDKFEAESLQKDKVDLSYVPPRYRSSYFQHIWGNGYAAGYYAYLWTEMLADDAFQWFTEHGGLTAENGQRFRDMILSRGNSQDLEKLYIDWRGKEPSIEPMLINRGLKDE

SEQ ID NO: 4106 - protein, 733 aa, Serratia sp.
MRLSTLVLAIGMALGAQALAAETQPHADHSALPSGQAKEATVTGEANQHDKQKTQNPFFYQSRLPFQAPPFNLIKESDYAPAIEAGIKQKREEVEKIANNPAKPNFKNTFVALERAGSLLTRVMNVFGAMTSANTSDALQKLDEETSPKLAALNDDIMLNGKLFARIKAIYQDRDALKLDPESRRLVEVTYKNFELAGANLSDADKAKLKALNQEAATLSTQFTNKLLAASKNGALAITDPAKLDGLSEGELAAAAQAAAERKLEKQWLLVLQNTTQQPLLQSLKDRDTRQALFDASWTRAEKGDGNDTRQTISRLAKVRAEQAKLLGYPNYAAWKLQNQMAKTPDAALSFMRNIVPAATARAEREAKDIQAVIDQQKGDFKVQAWDWQFYAEQVRKAKYDLDESQIKPYFELNNVLNNGVFYAANLLYGISFKERKDIPVYQPDVKVYEVFDKDGKSLALFYTDYFKRDNKGGGAWMSNFVDQSKLNGTKPVIYNVANFTKPAPGQPALLSYDDVITMFHEFGHALHGMFADQEYPSLSGTNTARDFVEFPSQFNEHWVSDPKVFSHFAKHYQSGEAMPQELVDKIKKAEKFNKGYSMTELLSAALLDMHWHMLTADQPQQDVDKFEAESLQKDKVDLSYVPPRYRSSYFQHIWGNGYAAGYYAYLWTEMLADDAFQWFTEHGGLTAENGQRFRDMILSRGNSQDLEKLYIDWRGKEPSIEPMLINRGLKDE

SEQ ID NO: 4107 - protein, 733 aa, Serratia sp.
MRLSTLVLAIGMALGSQAQAAETQPLADHSALPSGQAKEAIVTGEANQHGKQKTQNPFFYQSRLPFQAPPFNLIKEGDYAPAIAAGIKQKREEVEKIANNPAKPTFKNTLVALEQAGSLLTRVMNVFGAMTSANTSDALQKLDEETSPKLAALNDDIMLNGKLFARIKAIYQDRDALKLDPESRRLVEVTYKNFELAGANLSDADKAQLKALNQEAATLSTQFTNKLLAASKNGALAITDQAKLDGLSEGELAAAAQAAGERKLEKQWLLVLQNTTQQPLLQSLKDRDTRKTLFDASWTRAEAGDGNDTRQTLSRLAKVRAEQAKLLGYPNYAAWKLQNQMAKTPDAALSFMRNIVPAATARAEREATDIQAVIDRQKGDFKVQTWDWQFYAEQVRKAKYDLDESQIKPYFELNNVLNNGVFYAANLLYGISFKERKDIPVYQADVKVYEVFDKDGKSLALFYTDYFKRDNKGGGAWMSNFVDQSKLNGTKPVIYNVANFTKPAPGQPALLSYDDVVTMFHEFGHALHGMFADQEYPSLSGTNTARDFVEFPSQFNEHWVSDPKVFSHFAKHYQTGEAMPQELVDKLKKADKFNKGYSMTELLSAALLDMHWHMLTADQPQQDVDKFEAESLQKDKVDLSYVPPRYRSSYFQHIWGNGYAAGYYAYLWTEMLADDAFQWFTEHGGLTAENGQRFRDMILSRGNSQDLEKLYIDWRGKEPSIEPMLINRGLKDE

SEQ ID NO: 4108 - protein, 733 aa, Serratia sp.
MRLSTLVLAMSMALGTQAQAEESKTTSEHAALPSGQAKEATVTGEANQHENQKSDNPFFYQSRLPYQAPPFDRIKESDYAPAIEEGIKQKLAEVEKIANNPAKADFDNTLVALEKTGALLTRVMSVFGAMTSANTSDALQKLDEEVSPKLAAMDDAIMLNSKLFARIKAVYEQRDALKLDAESRRLLEVAYQSFELAGANLSDADKTKLKALNQEAATLSTQFTNKLLAAAKNGALAISDKSKLDGLSAGELAAAAQAASERKLDKQWLLVLQNTTQQPDLQTLKDRDTRKALFDASWTRAEKGDGNDTRQTIARLAKIRAEQAKLLGFPDYASWKLQNQMAKTPKAALSFMRDIVPAATARAQREAKDIQAVIDRQKGDFKLVAWDWQYYAEQVRKEKYDLDESQIKPYFELNNVLNNGVFYAANLLYGISFKQRKDIPVYQPDVRVYEVFDKDGKSLALFYTDYFKRDNKGGGAWMSNFVEQSKLNGTKPVIYNVANFTKPAPGQPALLSYDDVITMFHEFGHALHGIFADQQYPSLSGTNTARDFVEFPSQFNEHWARDPKVFAHFAKHYQTGAAMPQELVDKINKADKFNKGYDMTELLAAALLDMHWHMLSADQPQQDVDQFEAQSLQKDNIDLSYVPPRYRSSYFQHIWGNGYAAGYYAYLWTEMLADDAFQWFSEHGGLTAENGQRFRDMVLSRGNSEDLEKLYETWRGKAPSIEPMLINRGLKEQ

SEQ ID NO: 4109 - protein, 733 aa, Serratia sp.
MRLSTLVLAIGVALSTQALAEESKLPSENTAVPSGQSKEANVTGEANQHEDKKGENPFFYASRLPFQAPPFGVIKESDYAPAIAAGIQQKLAEVEKIANNPAEPTFENTLVALQSSGALLTRTMNVFSAMTSANTSDALQKLDEETSPKLAALDDAIMLNSKLFARIKSIYDRRDSLELDAESRRLAEVTYQNYVLAGANLSDTDKTQLKALNQEAATLSTQFTNKLLAAGKNGALAIDDKAQLTGLSDAERAAAAQAASERKLDKQWLLVLQNTTQQPDLQRLKDRDTRKALFDASVNRAEKGDANDTRQTVARLAKVRAEQAKLLGFPNYAAWKLQNQMAKTPDAALAFMRDIVPAATARAEREAKDIQAVIDQQNGGFKLAAWDWQFYAEQVRKAKYDLDESQITPYFELNNVLHNGVFYAANLLYGISFKERKDIPVYQPDVRVYEVFDKDGKSLALFYTDFFKRDNKGGGAWMSNFVEQSRLNGTKPVIYNVANFTKPAAGQPALLSYDDVITLFHEFGHALHGMFADQEYPSLSGTNTARDFVEFPSQFNEHWASDPKVFAHYARHYQTGEAMPQELVDKINKADKFNKGYAMTELLAAALLDMHWHMLAAGQPQQAVDKFEAASLQQDSIDLGYVPPRYRSSYFQHIWGNGYAAGYYAYLWTEMLADDAFQWFKEHGGLTAENGQRFRDKILSRGNSQDLEKLYVDWRGQEPSIEPMLLNRGLKDR

SEQ ID NO: 4110 - protein, 720 aa, Serratia sp.
MRLSTLVLAIGVALSMPALAETHTQTKEAKVAGEVKQDKQGENPFFAASQLPFQAPRFDVISESDYAPAIAAGIQQKLAEVEKIANNPAEPTFDNTFVALEKSGALLTRTMNVFGAMTSANTSDTLQKLDEETSPKLAALDDAIMLNSKLFARIKAIYDRRDSLNLDPESLRLVEVTYKNYVLAGANLSEADKTQLKALNQEAATLSTQFTNKLLAASKNGALAIGDKNLLAGLSEGELAAAAQAASERKLDKQWLLVLQNTTQQPDLQNLQDRDTRQKLFKASINRAEKNDANDTRQTLARLAKVRAEQAKLLGFPNYAAWKLQNQMAKTPDAALAFMRNIVPAATARAEREAKDIQAVIDRQNGGFQLAAWDWQFYAEQVRKEKYDLDESQIKPYFEMNNVLHNGVFYAANLLYGISFKERKDIPVYHPDVRIYEVFDKDGQSLALFYTDFFKRDNKGGGAWMSNFVEQSKLNGTKPVIYNVSNFTKPASGQPALLSYDDVITMFHEFGHALHGMFADQQYPSLSGTNTARDFVEFPSQFNEHWASDPQVFAHFAKHYQTGEAMPQALVDKINKADKFNKGYAMTELLAAALLDMHWHMLGADQPQQDVDKFEAASLRQDKIDLSYVPPRYRSSYFQHIWGNGYAAGYYAYLWTEMLADDAFQWFSDNGGLTAENGQRFREQVLSQGNSQDLEKLYVKWRGQEPSIEPMLINRGLKDK

SEQ ID NO: 4111 - protein, 735 aa, Xenorhabdus sp.
MRLSTLVLAIGLALGTQAQAEENKLGSDHTNVSSNQIKQVNVTGEANQQQYKKNKNPFFSPSVLPFQAPPFNKIKETDYAPAIAAGIKQKLKEVEKIANNPAPPDFKNTFVALEKSGAMLTRVMNVFGAMTSANTTNGLQKLNEETSPKLAAMNDEIMLNSRLFNRIKAIYQQRGTLNLDPESRRLVEVTYQNFELAGANLSDADKAKLKALNQEAATLSTQFTNKLLAATKNGALAIQDKARLDGLSDGEIAAAAQAASERKLDKQWLLVLQNTTQQPSLQNLKDRDTRKALFEASWTRAEKGDDNDTRQTLARLAKIRAEQAKLLGFPDYASWKLQNQMAKTPKTALKFLRDIVPAATARAEREAKDIQAVIDQQKGGFKLEAWDWPFYAEQVRKAKYDLDESQIKPYFELNNVLNNGVFYAANLLYGITFKERKDIPVYQPDVRVYEVFDKDRKPLALFYTDYFKRDNKNGGAWMNNFVDQSKLIGTKPVIYNVANFTKPAPGQPALLSYDDVITIFHEFGHTLHGMFADEKYPSLSGTNTARDFVEFPSQFNEYWARDPKVFAHYAKHYQTGEAMPQALVDKINKADKFNKGYSMTELLSAALLDMHWHMLTAAQPQQDVDKFEAESLQQDNIYLSYVPPRYRSSYFKHIWGGGYAAGYYAYLWTEMLADDAFAWFTEHGGLTAENGQLFRDKVLSRGNSEDLEKLYINWRGKPPSIKHMLKNRGLEEQKQ

SEQ ID NO: 4112 - protein, 731 aa, Xenorhabdus sp.
MRLSTLVLAISLALSAQAQAEENKLGSDNTNISSDQIKEANVTDGTDQQQYKHKNPFFYPSALPFQAPPFDKVKEADYAPAIAAGIKQKLAEVAKIANNPAPPNFKNTFVALEKSGAMLTRVMNVFGAMTSANTTDQLQKLDEEMSPKLAAMEDEIMLNSQLFSRIKTIYQQRETLKLAPESRRLVEVTYQRFELAGANLSDQDKAKLKALNQEAATLSTQFTNKLLTATKNGALAIQDKAKLNGLSDGEIAAAAQAASERKLDKQWLLVLQNTTQQPGLQDLKDRDTRQALFDASWSRAEKGDDNDTRQTLTRLAKVRAEQAALLGFPDYASWKLQNQMAKTPEAALKFLRDIVPAATARAEREAKDIQAVIDQQQGNFKLEAWDWPFYAEQVRKAKYDLDESQIKPYFELNNVLNNGVFYSANLLYGITFKERKDIPVYQADVRVYEVFDKNRKPLALFYTDYFKRDNKGGGAWMSNFVDQSKLFGTKPVIYNVTNFTKPAPGQPALLSYDDVSTLFHEFGHALHGMFAAQEYPTLSGTNTARDFVEFPSQFNEYWARDPKVFAHYAKHYQTGEAMPQALVDKINKADKFNKGYLMTELLSAALLDMHWHMLAADQPQQNVDTFEANALKQDNINLSYVPPRYRSSYFKHIWGGGYAAGYYAYLWTEMLADDAFAWFTEHGGLTPDNGQRFHDKVLSRGNSKDLEKLYIDWRGKPPSIEHMLKNRGLKE

SEQ ID NO: 4113 - protein, 730 aa, Xenorhabdus sp.
MRLSILVLSIGLALGTQVQAEENKLGSDHKNTSSGQAKELNVTDQTQEQYKHKNPFFSPSKLPFQAPPFDKIKESDYAPAITAGIKQKLEEVKKIANNPAKPSFENTFVALEKSGAMLTRVMNVFGAMTSSNSTQKLQDLDEKMSPKLAAMDDEIMLNSKLFSRIKTIYQQRGTLKLDPESLRLVEVTYLRFELAGANLSDADKVKLKALNQEAATLSTQFSNKLLLATRNGALAIKDKIKLDGLSDSEIAAAAQAASERNLDKQWLLVLQNTTQQPNLQDLKDRDTRKALFEASWTRAEKGDDNDTRQTLTRLAQIRAEQAKLLGFPDYASWKLQNQMAKTPKAALKFLRDIVPAATERAKREAKDIQAVIDQQQGGFKLEAWDWPLYAEQVRKAKYDLDESQIKPYFELNNVLNNGVFYAANLLYGITFKERKDIPVYHPDVHVYEIFDNNKKPLALFYTDYFKRDNKSGGAWMSNFVDQSKLTGTKPVIYNVTNFTKPAPGQAALLSYDDVITLFHEFGHALHGMFASQEYPSLSGTNTARDFVEFPSQLNEYWAQDTKIFAHYAKHYQTGEPMPQALVDKIKKADKFNKGYQMTELLSAALLDMHWHMLGADQPRQDVDKFEANALKQDNIDLSYVPPRYRSSYFSHIWGGGYAAGYYAYLWTEMLADDAFAWFTEHGGLTPENGQRFRDKILSRGNSEDLEKLYVDWRGKPPSIKHMLKNRGLEE

SEQ ID NO: 4114 - protein, 723 aa, Yersinia sp.
MRLSTLVLAMSMALAGQVQSAEIAVKGQLNKPQLEDEANRVGQNPFFSSSKLPFQAPPFNLIKESDYAPAIEFGIAERLAEVNAIANNPTLPTFKNTFIALEKSGGTLTRVMNGFGAMTSANSSDVLQKIDEETSPKLAAMEDAIKLNSTLFNRIKTIYDQRDKLGLDDESRRLVEVTYTNFILAGANLSDADKTKLKALNQEAAGLSTQFTNKLLAATKNGAVAVKDKSVLAGLSEGELAAAAQAAGDRQLDKQWLLVLQNTTQQPVLKNLSDRDTRKSLFDASWNRAEQGDANDTRQIVSRLAKIRAEQAQLLGFPNYAAWKLQNQMAKTPDTALTFMRDIVPAATARAEREAKDIQAVIDRQNGGFKLGPEDWKFYAEQVRKEKYDLDESQINPYFELDNVLNNGVFYAANQLFGISFKERTDLPVYHPDVRVYDVIDKDGQPLALFYTDYFKRDNKGGGAWMSNFVDQSKLLGTKPVIYNVANFTKPAPGQPALLSYDDVITLFHEFGHALHGIFADQQYPSLSGTATARDFVEFPSQLNEHWASDPKVFANYAKHYKTGEPMPQELVDKIQKAKKFNKGYSMTELLSAALLDMNWHMLNASQLEQDVDKFEKKSLQRDKIDLSYVPPRYRSSYFQHIWGNGYAAGYYAYLWTEMLADDAFVGLLESGGLTPENGQRLRDKILSRGNSQDLEKLYIDWRGQAPSIEPMLINRGLKEPAK

SEQ ID NO: 4115 - protein, 723 aa, Yersinia sp.
MRVSTLVLAMSMALTGQGHSTETLSSDPNNKSRLSGKTDVKSPNPFVSRSSLPFSAPPFDLIKESDYEPAIDLGIAERLAEVDAIANNPTPPTFENTFVTLEKSGAILTRVINVFGAMTSAHSSDTLRQIDETTSPKLAALNDAIMLNSKLFKRVKTVYHQRDTLGLDDESLRLVNVIYHNFVLAGANLSDADKIQLKALNQEAASLSTQFTHRLLAATKEGALAINEKAALAGLSKAELAAAAQAAHDRQLGQQWLLVLQNTTQQPALQNLSDRDTRKALFDASWNRTEKGDVHDTRNIISRQAKIRAEQAQLLGFPNYAAWKLQNQMAKTPDAALSFMRNIVPAATARAEREAKDIQAVIDRQKGGFKLGPEDWQFYAEQVRKDKYALDESQIKPYFELNNVLNNGVFYAANQLFGIRFKERKDLPVYHPDVRVYDVIDNDGQPLALFYTDYFKRDNKGGGAWMSNFVDQSKLLGSKPVIYNVANFSKPATGQPALLTYDEVITLFHEFGHALHGFFANQQYPSLSGTATARDFVEFPSQLNEYWASDTQVFSHYAKHYQTGEPMPPALVDKIQKADKFNKGYSMTELLSAALLDMHWHTLSASQPPQDVDLFERESLRRDNIDLSYAPPRYRSSYFQHIWGNGYAAGYYAYLWTEMLADDAFEGLKENGGLTRENGQRLRDKILSRGNSQDLEKLYIDWRGKAPEIEPMLINRGLKETNP

SEQ ID NO: 4116 - protein, 720 aa, unknown
  environmental sample
MRLSNLFLAISLACSSYVAVAETPSTATSKQENVMNSPEQTVNPFFERSPLIYQAPQFDKYKESDYAPAIAEGIKQKLAEVDKIANDTAPPTFENTYVALEKSGVLLTRVLSVFDAMTSANTTDGLQKIDEETSPKLAAMSDSIHLNSKLFDRLKTVYEQRNSLKLDAESQRLIEVTYKDFELAGANLSDADKEKLKALNQQAATLSTQFTNKLLAASKAGGLTVKDQKQLAGLSEAELSAASQAAKDRKLTDAWLLVLQNTTQQPLLQPLEDRDTRKALYEASINRAEHGDANDTRQLISKLAKVRAEQAQILGFPSYAAWKLQNQMAKTPQAALDFMHKIVPAATARAEREAQDIQALIDKQKGGFKLAAWDWQHYSEQVRKEKYDLDDAQIKPYFELNNVLENGVFYAANLLYGVTFKERHDLPVYNPDVRVFEVFDKDGQSMALFYADYYQRDNKGGGAWMSNFVDQSKLFGTKPVIYNVANFQKPAEGKPALLSWDDVITMFHEFGHALHGLFADQQYPSLSGTATPRDFVEFPSQFNEHWASDPKVFSHFAKNYQTGEAMPQALRDKIEKASKFNKGYEMTELLAAALLDMHWHSLSASEPEQDVDKFEAASLKKDNIDLAYVPPRYRSSYFQHIWGNGYAAGYYAYLWTEMLADDAFAGIEEQGGLTRENGQKFRDQILSRGNSEELEKLYETWRGKAPSIEPMLINRGLKEE

SEQ ID NO: 4117 - protein, 719 aa, Rahnella sp.
MRISPLFLAITLACSQYAVGAEPTSAPALTQEHVMNHAINADNPFLKPSPLEYQAPQFNLYKDSDYEPAILEGIRQKLAEVDKIASDSAPPTFENTYVALEKSGVMLQRVQNVFGAMTGANTNDTLQKIDEDTSPKLAAMDDSIHLNSKLFARLKAVYDQRSSLKISPESQRLIEVTFKDFELAGANLSDADKDKLRALNQQAATLSTQFTNKLLAATKAGGLTVKDKAQLAGLSDAELSAAAQAAKDRKLDNAWLLVLQNTTQQPLLQSLDDREARKALYEASINRAEKGDANDTRELIAKLAKVRAEQARVLGFPSYAAWKLEDQMAKTPKAALDFMHKIVPAATARAGREAADIQAEIDKQNGGFKVAAWDWQHYAQQVRKEKYDLDDAQIKPYFELNNVLENGVFYAANLLYGITFKERKDLPVYNPDVRVFEVFDKDGKSMALFYADYYQRDNKGGGAWMSNYVDQSKLLGNKPVIYNVANFQKPAAGQPALLSWDDVITLFHEFGHTLHGLFADQEYPGLSGTATPRDFVEFPSQFNEHWASDPKVFTHFAKHYKTGEVMPQALQDKIEKASKFNKGYDMTELLAAALLDMHWHSLGADAPQQDVDKFEAESLAKDKVNLAYVPPRYRSSYFQHIWGNGYAAGYYAYLWTEMLADDAFAGITEQGGLTRENGQKFRDQILSRGNSEDLEKLYETWRGKAPSIEPMLKNRGLEE

SEQ ID NO: 4118 - protein, 686 aa, Ewingella sp.
MNSPEQTVNPFFERSPLIYQAPQFDKYKESDYAPAIAEGIKQKLAEVDKIANDSAAPTFENTYVALEKSGVLLTRVLSVFDAMTSSNTTDGLQKIDEDTSPKLAAMSDSIHLNSKLFDRLKTVYEQRNSLKLDAESQRLIEVTYKDFELAGANLSDADKEKLKALNQQAATLSTQFTNKLLAASKAGGLTVKDQKQLAGLSEAELSAASQAAKDRKMTDAWLLVLQNTTQQPLLQPLEDRDTRKALYEASINRAEHGDANDTRQLISKLAKVRAEQAQILGFPSYAAWKLQNQMAKTPQAALDFMHKIVPAATARAEREAQDIQALIDKQKGGFKLAAWDWQHYSEQVRKEKYDLDDAQIKPYFELNNVLENGVFYAANLLYGVTFKERHDLPVYNPDVRVFEVFDKDGQSMALFYADYYQRDNKGGGAWMSNFVDQSKLLGTKPVIYNVANFQKPAEGKPALLSWDDVITMFHEFGHALHGLFADQQYPSLSGTATPRDFVEFPSQFNEHWASDPKVFSHFAKNYQTGEAMPQALRDKIEKASKFNKGYDMTELLAAALLDMHWHSLSANEPEQDVDKFEAASLKKDNIDLAYVPPRYRSSYFQHIWGNGYAAGYYAYLWTEMLADDAFAGIEEQGGLTRENGQKFRDQILSRGNSEDLEKLYETWRGKAPSIEPMLINRGLKEE

SEQ ID NO: 4119 - protein, 727 aa, Rhodanobacter sp.
MLRLRTIVIATTMALAACSQQPHEAANPPAPTAPAAASSTATAMTSNPFYSASTLPFQAPPFDKIHDADYQPAIEEGMRQQLAEIEKIANDPAAPTFENTYVAMEKSGAMLHRVMAAFNAVTGANTNDTLQKVQEQEAPKLAAHEDAIHLDGKLFQRVQTIYDQRDTLKLDPESARLVEVVYKNFVHAGAKLSDADKAKLKDLNKEESTLSTAFTNKLLTATKDAAPVIADKAQLAGLSDAELAAAAQAGKERKQDGKYVLTLQNTTQQPELQDLTDRATRQALFEASWTRAERGDANDTRKTIERLAQIRAEQAKLLGYPDYAAWKLDDQMAKTPETALKFMQDLVPAVTARAKTEAGDIQAVIDQQHGDFKLAPWDWNFYAEQVRKAKFDLDENQIKPYFELDDVLQNGVFYAANQLYGLTFKERHDIPVYQPDMRVFEVFDQDGKSLALFYTDYFKRDNKGGGAWMDNLVTQSKLLGSKPVIFNVCNFSKPAAGQPALLSFDDVTTMFHEFGHALHGIFADEQYPTLSGTNTARDFVEFPSQFNEHWATDPKVFAHYAKHYQTGEPMPQALVDKMKKAGKFNKGYEMTELVAAALLDMNWHMLGADAPLQDADQFEAAALKKDGIDLSYVPPRYRSSYFQHIWGNGYAAGYYAYLWTQMLADDAFIGFKEHGGLTRENGDRFRAMVLSRGNTEELAKMYRDWRGHDPEIEPMLENRGLKDAPKP

SEQ ID NO: 4120 - protein, 521 aa, Serratia sp.
MSLIYRALFYAFAVILSFFSSTAVVAGQLILKNISLSPITCTVDGWTVSSGSSFDWFIKVQPGQSFFVGQNTSRPKDPVINWAKCNNLHTRAMTITPSGPNQTLVLNGQQTQVLNVSLYPFLPTLPTDNFENLVAYIVQTYQSQHPQVLLNAVLNPQVNIYSFTELPVLLGNDGFDVIELDVLYLGFLADNHLINPAQITGEAPWAVALAGATYQGQLWAIPSWLCMDFFYAFDQAIQQQKTLSKMLNYLNTRTSSVAKMAGSFNGSWAIPSDYINAYVQTYGYGALQQAMQMPPDNGVVHQLVSLSDTCSFNGVNKCTNNTYHNAPNGGAEQVFASGQASTDMGFSEQSFYVNLYSSAQKPLYVVPTPWGEHPQPLLFEDAFVSSAATCKPGSQCAANAQAFTTLMTGTAMKNYIVQSKDLPAGTPWRTLLVATQQFWQQSIIANNSYYQQLSPIFMTAKAFPNNFTPQSQVAMANGICNALKQQQPNFVCKSNNSTSLLAPSHGSSIINPRSTDSRRGL

SEQ ID NO: 4121 - protein, 521 aa, Serratia sp.
MNLIYRALFYAFAVMLSFFSSTAVVAGQLILKNTSLSPITCTVDGWTVSSGSSFDWFIKVQPGQSFFVGQNTSRPKDPVINWAKCNNLQTRAMTITPSGPNQTLVLNGQQTQVLNVSLYPFLPTLPTDNFENLVAYIVQTYQSQHPQVLLNAVLNPQVNIYSFTELPVLLGNDGFDVIELDVLYLGFLADNHLINPAQITGEAPWAVALAGATYQGQLWAIPSWLCMDFFYAFDQAIQQQKTLSKMLNYLNTRTSSVAKMAGSFNGSWAIPSDYINAYVQTYGYGALQQAMQMPPDNGVVHQLVSLSDTCSFNGVNKCTNNTYHNAPNGGAEQVFASGQASTDMGFSEQSFYVNLYSSAQKPLYVVPTPWGEHPQPLLFEDAFVSSAATCKPGSQCAANAQAFTTLMTGTAMKNYIVQSKDLPAGTPWRTLLVATQQFWQQPIITNNSYYQQLSSIFMTAKAFPNNFTAQSQVAMANDICNALKQQQPNFVCKSNNSTSLLAPSHGSSIINPGNTDSRRGL

SEQ ID NO: 4122 - protein, 521 aa, Serratia sp.
MNLIYRALFYAFALMLSFFSSTAVIAGQLILKNTSLSPITCTVDGWTVSSGSSFDWFIKVQPGQSFFVGQNTSRPKDPVINWAKCNNLQTRAMTITPSGPNQTLVLNGQQTQVLNVSLYPFLPTLPTDNFENLVAYVVQTYQSQHPQVLLNAVLNPQVNIYSFTELPVLLGNDGFDVMELDVLYLGFLADNHLINPAQITGEAPWAVALAGATYQGQLWAIPSWLCMDFFYAFDQAIQQQKTLSKMLNYLNTRTSSVAKMAGSFNGSWAIPSDYINAYVQTYGYGALQQAMQMPPDNGVVHQLVSLSDTCSFNGVNKCTNNTYHNAPNGGAEQVFASGQASTDMGFSEQSFYVNLYSSAQKPLYVVPTPWGEHPQPLLFEDAFVTSAATCKPGSQCATNAQAFTTLMTGTAMKNYIVQSKDLPVGTPWRTLLVATQQFWQQSIITNNGYYQQLSSIFMTAKAFPNNFTPQSQVAMANGICNALKQQQPNFVCKSNNSTSLLAPSHGSSIINPGSTDSRRGL

SEQ ID NO: 4123 - protein, 462 aa, Serratia sp.
MQPGQSFFVGQNTSRPKDPVINWAKCNNLQTRAMTITPSGPNQTLVLNGQQTQVLNVSLYPFLPTLPTDNFENLVAYIVQTYQSQHPQVLLNAVLNPQVNIYSFTELPVLLGNDGFDVMELDVLYLGFLADNHLINPAQITGEAPWAVALAGATYQGQLWAIPSWLCMDFFYAFDQAIQQQKTLSKMLNYLNTRTSSVAKMAGSFNGSWAIPSDYINAYVQTYGYGALQQAMQMPPDNGVVHQLVSLSDTCSFNGVNKCTNNTYHNAPNGGAEQVFASGQASTDMGFSEQSFYVNLYSSAQKPLYVVPTPWGEHPQPLLFEDAFVSSAATCKPGSQCAANAQAFTTLMTGTAMKNYIVQSKDLPAGTPWRTLLVATQQFWQQSIIANNSYYQQLSPIFMTAKAFPNNFTPQSQVAMANGICNALKQQQPNFVCKSNNSTSLLAPSHGSSIINPGSTDSRRGL

SEQ ID NO: 4124 - protein, 521 aa, Serratia sp.
MGFLSRIVVHTVVIGILAFGNAVAFAGQLILKNMSSNPITCTVDGWTISSGSSFDWYIKVQPGQSFYVGQNTSRPNSPIINWANCNNLQTRSMTVTPSGPNQTLVLNGQQTRVLNVSLYPYLPTLPTDDFENLVAYIVQTYQAQHPQVLLNAVLNQAVDIYSFDALPTLLGHEGFDVIELDVLYLGFLADNHLINPVQITGDAPWPVALAGSTYKYQLWGIPSWLCMDFIYDYNHEITTQKSLTQLITYLGTRSPDIPELVGSYNGSWSIPSDYINAYVQTYGFEALQQSMQMPPDEAVVKQLVTLSDTCEHNGINKCTNNTYHHAPNGTTEQVFATGQASTDMGFSEQSFFIRLYQSTHDPLYVTPTPWGEKPQPLLFQDSFVSSAATCSPGSNCAADAQAFTTLMTSVAMKNYIVQSKDLPAGSPWRTLLVANQQFWQQPLIADNAYYQQLQPIFATAQAFPNNFTEQVQTEMATQICTALKQQQPMFVCDSGTNTTLLAPSHSRLSSPQKPAQSRRGL

SEQ ID NO: 4125 - protein, 133 aa, Serratia sp.
MSIGPVSGNGITITLPVGKTLFWTANVQASYSQYVLVRDSTNQVVIESKGASTGGHSPTQIGQGSFVTAGSGVYTVFIGYNNGQSWSQVMWDEIALNIGSQIYSSCFNFISEDGADRDFNDTCLTLTWFNSIG

SEQ ID NO: 4126 - protein, 112 aa, Serratia sp.
MAIGHYELKKAKNGQYHFNLKASNGEIILGSEMYASKASAENGIASVQTNSPQEGQYELKHSTSNQPYFVLKAKNHQVIGVSEMYSSETAAKNGIQSVIKNGPSTDVRDLSA

SEQ ID NO: 4127 - protein, 112 aa, unknown
  environmental sample
MAIGHYELKKAKNGQYHFNLKASNGEIILASEMYASKASAENGIASVQTNSPHEAQYELKHSTSNQPYFVLKAKNHQVIGVSEMYSSETAAKNGIQSVIKNGPATDVRDLSA

SEQ ID NO: 4128 - protein, 112 aa, Serratia sp.
MAIGHYELKKAKNGQYHFNLKASNGEIILASEMYASKASAENGIASVQTNSPHEAQYEIKHSTSNQPYFVLKAKNHQVIGVSEMYSSETAAKNGIQSVIKNGPNTDVRDLSA

SEQ ID NO: 4129 - protein, 112 aa, Serratia sp.
MANGHYELKKAKNGQYHFNLKASNGEIILASEMYASKASAENGIASVQTNSPHEAQYEIKHSTSNQPYFVLKAKNHQVIGVSEMYSSETAAKNGIQSVIKNGPNTDVRDLSA

SEQ ID NO: 4130 - protein, 112 aa, Serratia sp.
MAIGHYELKKAKNGQYHFNLKASNGEIILASEMYASKASAENGIASVQTNSPHEAQYELKHSASNQPYFVLKAKNHQVIGVSEMYSSESAAKNGIQSVIKNGPTTDIRDLSA

SEQ ID NO: 4131 - protein, 112 aa, Serratia sp.
MAIGHYELKKAKNGQYHFNLKASNGEIILASEMYASKASAENGIASVQTNSPHEAQYELKHSASNQPYFVLKAKNHQVIGVSEMYSSESAAKNGIQSVTKNGPTTDIRDLSA

SEQ ID NO: 4132 - protein, 112 aa, Serratia sp.
MAIGHYELKKAKNGQYHFNLKASNGEIILASEMYASKASAENGIASVQTNAPHEAQFELKHSTSNQPYFVLKAKNHQVIGVSEMYSSESAAKNGIQSVMKNGPTTDIRDLSA

SEQ ID NO: 4133 - protein, 112 aa, Serratia sp.
MAIGHYELKKAKNGQYHFNLKASNGEIILVSEMYASKASAENGIASVQTNSPHEAQFELKHSTSNQPYFVLKAKNHQVIGVSEMYSTESAAKHGIQSVMKNGPTIDIRDLSA

SEQ ID NO: 4134 - protein, 112 aa, Serratia sp.
MATGHYELTKSSNGQYHFNLKASNGEIILSSEMYASKASAENGIASVQINSPHEAQFEMKTSSNNKPYFVLKAKNHQVIGTSQMYSSESAAKNGIQSVIKNGPTTDVRDLSA

SEQ ID NO: 4135 - protein, 112 aa, Serratia sp.
MANGHYELKKSSNGQYHFSLKASNGEIILSSEMYASKASAENGIASVQTNSPHEAQFEVKVSSNNKPYFVLKAKNHQVIGTSQMYSSESAAKNGVQSVIKNGPTTDVRDLSV

SEQ ID NO: 4136 - protein, 112 aa, Serratia sp.
MASGHYELTKSSNGQYHFNLKASNGEIILSSEMYASKASAENGIASVQTNSPHEAQFEVKISSNNKPYFVLKAKNHQVIGTSQMYSSDSAAKGGIQSVIKNGPTTDVRDLSV

SEQ ID NO: 4137 - protein, 112 aa, Yersinia sp.
MATGHYEIKKAKNGQYHFNLKASNGEIILTSEMYASKASAENGISSVQSNSPLESQYELKHNTKNEPYFVLKAKNHQIIGVSESYSSEAAAKNGIASVIKNGPTTIIKDLTL

SEQ ID NO: 4138 - protein, 114 aa, Serratia sp.
MANGHYELKKSSSNGQFHFTLKASNGEIILSSEMYTSKASAENGIASVQTNSPHEAQYESKVSSNGKPYFVLKAKNHQVIGTSQMYSSDSAAKNGIQSVIKNGPTTDVRDLSAG

SEQ ID NO: 4139 - protein, 112 aa, Yersinia sp.
MATGHYEIKKAKNGQYHFNLKASNGEIILTSEMYASKASAENGISSVQSNSPLESQYELKHNTKNEPYFVLKAKNHQIIGVSESYSSEAAAKNGIASVMKNGPTTIIKDLTL

SEQ ID NO: 4140 - protein, 113 aa, Hafnia sp.
MAIGYYEIKKAKNGQFHFNLKASNGEIILSSEMYASKASADNGIASVQANSPDEAQFEIKNSSSDQPYFVLKAKNHQVIGTSEMYSSESAAKKGIQSVVKNGATTDIRDLTHG

SEQ ID NO: 4141 - protein, 112 aa, Yersinia sp.
MATGHYEIKKAKNGQYHFNLKASNGEIILTSEMYASKASAENGISSVQSNSPLESQYELKHNTKNEPYFVLKAKNHQIIGVSESYSSEAAAKNGIASAMKNGPTTIIKDLTL

SEQ ID NO: 4142 - protein, 112 aa, Yersinia sp.
MAMGHYEIKKAKNGQYHFNLKASNGEIILSSEMYASKASAENGIASVQSNSPLESQYESKRNVKNEPYFVLKAKNHQVIGVSEAYSSEAAAKNGIASVMKNGPTATIKDLTL

SEQ ID NO: 4143 - protein, 112 aa, Yersinia sp.
MATGHYEIKKAKNGQYHFNLKASNGEIILSSEMYASKASAENGISSVQSNSPLESQFELKRNVKNEPYFVLKAKNHQIIGVSESYSSESAAKNGIASVMKNGPTTTIKDLTL

SEQ ID NO: 4144 - protein, 113 aa, Enterobacteriaceae sp.
MASGHYDLKKSTNGQQFHFNLVASNGEIILSSEMYNSKASAENGIASVQTNSPSEAQYELKQSTNGKPYFVLKAKNHQIIGQSQMYSAEASAKNGIQSVMKNGPTTDIRDLTQ

SEQ ID NO: 4145 - protein, 112 aa, Rahnella sp.
MATGHYDLKKAKNGQFHFNLKAGNGEIILTSEMYASKASAENGISSVQTNSPEEAQYEIKPSKDGQFYFVLKAKNHQVIGISEMYTTESASKKGVQSVVKNGASTDIRDLTQ

SEQ ID NO: 4146 - protein, 112 aa, Ewingella sp.
MATGHYELKKAKNGQFHFNLKAGNGEIILTSEMYASKASAENGIASVQTNSPDEKQYEVKPAKDGQHYFVLKAKNHQIIGVSEMYTTDAAARKGIASVTKNGPTTDIRDLTS

SEQ ID NO: 4147 - protein, 115 aa, Rahnella sp.
MANGHYDLKKAKNGQFHFNLKAGNGEIILTSEMYASKASAENGISSVQTNAPDEAQYEVKPSKDGQFYFVLKAKNHQVIGVSEMYSTESASKKGVQSVVKNGTSTDIRDLTQQTA

SEQ ID NO: 4148 - protein, 115 aa, Rahnella sp.
MANGHYDLKKAKNGQFHFNLKAGNGEIILTSEMYASKASAENGISSVQTNAPDEAQYEVKPSKDGQFYFVLKAKNHQVIGVSEMYSTESASKKGVQSVVKHGTSTDIRDLTQQTA

SEQ ID NO: 4149 - protein, 127 aa, Yersinia sp.
MTTLIRGITCNRRNTMALGHYEIKKAKNGQYHFNLKASNGEIILSSEMYASKASAENGIASVQSNSPQESQYELKHNTKNEPYFVLKAKNHQVIGVSESYSSPTAAKNGIASVMKNGLSTVIKDLTL

SEQ ID NO: 4150 - protein, 115 aa, Candidatus sp.
MVNGYYEIKKAKNGQYYFNLKAGNHEIILTSEMYVSKASAENGIASVQTNSPDEKQYEMKLNVRNEPYFLLKAKNHQVIGKSEFYSSDAAAQKGIASVSRNGKTTDVRDLSDKEL

SEQ ID NO: 4151 - protein, 112 aa, Serratia sp.
MATGHYELKKSSKGLYHFILKASNGEVILSSEMYASKASAENGIVSVQSNAPHEAQFEVKISSCNRPYFVLRAKNHQVIGTSQIFSSESAAKNGVRSVIKHGSTPHVRDVNA

SEQ ID NO: 4152 - protein, 115 aa, Candidatus sp.
MINGYYEIKKAKNGQYYFNLKAGNHEIILTSEMYVSKASAENGIASVQTNSPDEKQYEVKLNVRNEPYFLLKAKNHQVIGKSEFYNSDAAAQKGIASVSRNGKTTDVRDLSDKEL

SEQ ID NO: 4153 - protein, 114 aa, gamma sp.
MATGHYDLKKAKNGQFHFNLKAGNGEVILSSEMYASKASAENGITSVQINAADEGQYEIKPSKDGQHYFVLRAKNHQVIGVSEMYTAASAAQKGMKSVVQNGPSTDIRDLTTHH

SEQ ID NO: 4154 - protein, 159 aa, Serratia sp.
MKGDKKIIAHLNKLLGNELVAINQYFLHARMFKNWGLMRLNDKEYHESIDEMKHADRYIERILFLEGLPNLQDLGKLNIGEDIEEILRSDLALELDGAKNLREAIAYADSIHDYVSRDLMIEILADEEGHIDWLETELDLIARLGIQNYAQAQILERKD

SEQ ID NO: 4155 - protein, 159 aa, Serratia sp.
MKGDKKIIAHLNKLLGNELVAINQYFLHARMFKNWGLMRLNEKEYHESIDEMKHADRYIERILFLEGLPNLQDLGKLNIGEDVEEMLRSDLALELDGAKNLREAIAYADSIHDYVSRDLMKEILADEEGHIDWLETELSLIERLGIQNYSQAQVLERKD

SEQ ID NO: 4156 - protein, 159 aa, Serratia sp.
MKGDKKIIAHLNKLLGNELVAINQYFLHARMFKNWGLMRLNEKEYHESIDEMKHADRYIERILFLEGLPNLQDLGKLNIGEDVEEMLRSDLALELDGAKNLREGIAYADSIHDYVSRDLMKEVLADEEGHIDWLETELSLIERLGIQNYCQAQVLERKD

SEQ ID NO: 4157 - protein, 159 aa, Serratia sp.
MKGDKKIIAHLNKLLGNELVAINQYFLHARMFKNWGLMRLNEKEYHESIDEMKHADRYIERILFLEGLPNLQDLGKLNIGEDVEEMLRSDLTLELDGAKNLREGIAYADSIHDYVSRDLMKEVLADEEGHIDWLETELSLIERLGIQNYCQAQVLERKD

SEQ ID NO: 4158 - protein, 159 aa, Serratia sp.
MKGDKKLIAHLNKLLGNELVAINQYFLHARMFKNWGLMRLNDKEYRESIDEMKHADRYIERILFLEGIPNLQDLGKLNIGEDIEEMLRSDLALELEGAKNLREGIAYADSIHDYVSRDLMKDVLADEEGHIDWLETELSLIERLGIQNYAQAQLLERKD

SEQ ID NO: 4159 - protein, 154 aa, Serratia sp.
MKGDKKIIAHLNKLLGNELVAINQYFLHARMFKNWGLTRLNDKEYHESIDEMKHADRYIERILFLEGIPNLQDLGKLNIGEDIEEMLRSDLTLELDGAKGLREAIAYADSIHDYVSRDLMIEILADEEEHIDWLETELDLIDRLGIQNYAQAQL

SEQ ID NO: 4160 - protein, 157 aa, Pectobacterium sp.
MKGDKKVITHLNKLLGNELVAINQYFLHARMFKNWGLTRLNDHEYHESIDEMKHADRYIERILFLEGIPNLQDLGKLNIGEDVEEVLRSDLQLELDGAKNLREAIAYSDSVHDYVSRDLMIEILADEEGHIDWLETELDLIARLGIQNYLQAQLKAE

SEQ ID NO: 4161 - protein, 158 aa, Hafnia sp.
MKGDKKVITHLNKLLGNELVAINQYFLHARMFKNWGLTRLNDVEYHESIDEMKHADRYIERILFLEGLPNLQDLGKLNIGEDVEEMLRSDLKLELDGAKNLREGIAYCDSVHDYVSRDLMIDILSDEEKHIDWLETELDLIQRLGIQNYLLAQVKEEA

SEQ ID NO: 4162 - protein, 157 aa, Dickeya sp.
MKGDKKVIAHLNKLLGNELVAINQYFLHARMFKNWGLKRLNDHEYHESIDEMKHADRYIERILFLEGVPNLQDLGKLNIGEDIEEMLRSDLALELEGARDLREAISYADSVRDYVSRDLMIEVLADEEEHIDWLETELELIARLGIQNYLQTQLKEE

SEQ ID NO: 4163 - protein, 157 aa, Dickeya sp.
MKGDKNVITHLNKLLGNELVAINQYFLHARMFKNWGLKRLNDHEYHESIDEMKHADRYIERILFLEGVPNLQDLGKLNIGEDIEEMLRSDLALELEGARDLREAISYADSVRDYVSRDLMIEVLADEEEHIDWLETELELIARLGIQNYLQTQLKEE

SEQ ID NO: 4164 - protein, 158 aa, Enterobacter sp.
MKGDVKVINYLNKLLGNELVAINQYFLHARMFKNWGLMRLNDVEYHESIDEMKHADKYIERILFLEGIPNLQDLGKLGIGEDVEEMLRSDLALELDGAKNLREAIAYADSVHDYVSRDMMIEILKDEEGHIDWLETELDLIGKIGLQNYLQSQIKVEE

SEQ ID NO: 4165 - protein, 158 aa, Achromobacter sp.
MKGDVKIISYLNKLLGNELVAINQYFLHARMFKNWGLMRLNDVEYHESIDEMKHADKYIERILFLEGIPNLQDLGKLGIGEDVEEMLRSDLRLELEGAKDLREAIAYADSVHDYVSRDMMIQILADEEGHIDWLETELDLIGKIGLQNYLQSQIKVED

SEQ ID NO: 4166 - protein, 158 aa, unknown
  environmental sample
MKGDIKIINYLNKLLGNELVAINQYFLHARMFKNWGLMRLNDVEYHESIDEMKHADKYIERILFLEGIPNLQDLGKLHIGEDVEEMLRSDLNLEMEGAKDLREAIAYADTIHDYVSRDMMIQILADEEHHIDWLETELDLISKIGLQNYIQSQIKEES

SEQ ID NO: 4167 - protein, 163 aa, Serratia sp.
MKGDTKMISHLNKLLGNELVAINQYFLHARMFKNWGLMRLNGIEYHESIDEMKHADIYIERILFLEGIPNLQDLGKLNIGEDVEEMLKSDLVLELDGAKDLREAIAYADSIHDYVSRDIMITILADEEHHIDWIETEVDLISRVGIQNYIQTQIKEESKKASH

SEQ ID NO: 4168 - protein, 158 aa, unknown
  environmental sample
MKGDVKIINYLNKLLGNELVAINQYFLHARMFKNWGLMRLNDIEYHESIDEMKHADLYIERILFLEGIPNLQDLGKLHIGEDVEEMLQSDLKLELDGAKDLREAIAYADSVHDYVSRDMLITILTEEEHHIDWLETELELISKIGLQNYLQSQIKVAD

SEQ ID NO: 4169 - protein, 157 aa, unknown
  environmental sample
MKGDAKIISHLNKLLGNELVAINQYFLHARMFKNWGLMRLNDIEYHESIDEMKHADKYIERILFLEGLPNLQDLGRLRIGEDVEEMLKSDLALELEGARDLREAIAYADKVHDYVSRDMMIVILEDEEHHIDFLETELELMGKVGVQNYLQTQIKVE

SEQ ID NO: 4170 - protein, 165 aa, Cronobacter sp.
MEAEGSKMKGDIKIINYLNKLLGNELVAINQYFLHARMFKNWGLMRLNDVEYHESIDEMKHADIYIERILFLEGIPNLQDLGKLHIGEDVEEMLRSDLTLEMEGAKDLREAIAYADSIHDYVSRDIMIKILEDEEHHIDWLETELDLIGKIGLQNYIQSQIKEQS

SEQ ID NO: 4171 - protein, 148 aa, Enterobacter sp.
LNKLLGNELVAINQYFLHARMFKNWGLTRLNDVEYHESIDEMKHADKYIERILFLEGIPNLQDLGKLGIGEDVEEMLRSDLRLELEGARDLREAIAYADSVHDYVSRDMMIQILADEEGHIDWLETELDLITKIGLQNYLQSQIKVES

SEQ ID NO: 4172 - protein, 158 aa, Arsenophonus sp.
MKGDKRMITHLNTLLGNELVAINQYFLHARMFKNWGLLRLNNIEYEESIDEMKHADKYIERILFLEGIPNLQDLGKLNIGENVEEMLKSDLLLELEGARDLRSAIAYADSVSDYVSRDLMIEILTDEEKHIDWIETQLVLIANIGLKNYLQSQLGEEA

SEQ ID NO: 4173 - protein, 145 aa, Pantoea sp.
KLLGNELVAINQYFLHARMFKNWGLTRLNDVEYHESIDEMKHADKYIERILFLEGIPNLQDLGRLRIGEDVEEMLGSDLALELEGAKDLREAISYADKVHDYVSRDMMIEILADEEHHIDWIETELELIRKMGIQNYLQAQIKEE

SEQ ID NO: 4174 - protein, 161 aa, Vibrio sp.
MKGDPIIIQHLNKILGNELVAINQYFLHARMYKDWGLKHLADKEYHESIDEMKHADHLIERILFLEGLPNLQDLGKLKIGEDTQEMLECDLALEMEAIPDLKNAIAYAEDIHDYVSRDLFLEILEDEEEHVDWLETQLGLVKMTGIQNYLQAQYVDEDDDG

SEQ ID NO: 4175 - protein, 153 aa, Sodalis sp.
MKGDAQIINHLNKLLGNELVAINQYFLHARMFKNWGLMRLNDVEYHESIDEMKHADCYIERILFLEGLPNLQDFGRLNIGEDVEEMLRSDLYLELQGAQDLREGIVYADSIRDYVSRDLMIEILPTKKSILIFWKPSWRLLPVSAFRTICNHS

SEQ ID NO: 4176 - protein, 160 aa, Vibrio sp.
MKGDPIIIQHLNKILGNELVAINQYFLHARMYKDWGLKHLADKEYHESIDEMNHADHLIERILFLEGVPNLQDLGKLMIGEDTKEMLECDLKLEMAAIPDLKAAIAYAEDTHDYVSRDLFQDILEDEEEHVDWLETQLGLIDMTGIQNYLQAQYVDEDDD

SEQ ID NO: 4177 - protein, 660 aa, Serratia sp.
MTELTPGIAAPLGAHYDGSGINFTLFSAHATGVELCLFDGQQREVRLPLPARSGDIWHGYLPGGKPGQRYAYRVHGPFDPAQGLRFNPNKLLLDPAARAVEGPVADDLELHGGYDRPDPQDSAEVMPKCVVIDEAYDWQDDRPPATPWGKTVIYEAHVRGLTLLHPDIPPVLRGSFAALGHPVMIAHFKRLGITALELLPVQQHSSEPRLQRLGLINYWGYNVLAPYAPDNRYCSLRTDMTPLREFRDAVKALHKAGIEVILDVVFNHSAELDMDGPTLSLRGIDNPEYYWLTPDGGYVNDTGCGNTLRLDKPQGVAWVMDCLRFWVSECHVDGFRFDLGSVLGRTPAFDRDAPLFQAMLADDLLSRCKLIAEPWDIGPGGYQVGAFPGRFAEWNDHYRDDIRRFWLQGDLPLGQFAQRFAGSSDLFNQRGRAPYAGINMLTAHDGFTLQDLVSFNRKHNQLNGEGNRDGSDHNFSYNHGVEGPIADDAIVQRRRASRQALLATLLLSQGTPMLLAGDEHGHSQQGNNNAYCQDNAITWLDWAKADDSLTAYTAALIHLRRQIPALQQDRWWQEGDGSVQWLNAQGLPPAAQEWEQGDLQLQIRLSQRWLVVVNATPQPVEMRLPAGDWQVVAPFTQEGPQAVLPAWNQAAHSICVLVQK

SEQ ID NO: 4178 - protein, 660 aa, Serratia sp.
MTELTPGIAAPLGAHYDGNGINFTLFSAHATGVELCLFDGQQREVRLPLPARSGDIWHGYLPGGKPGQRYGYRVYGPFDPAQGLRFNPNKLLLDPAARAVEGPVADDLELHGGYDRPDPQDSAEVMPKCVVIDEAYDWQDDRPPATPWGKTVIYEAHVRGLTLLHPDIPPVLRGSFAALGHPVMIAHFKRLGITALELLPVQQHSSEPRLQRLGLINYWGYNVLAPYAPDNRYCSLRTDMTPLREFRDAVKALHKAGIEVILDVVFNHSAELDMDGPTLSQRGIDNPGYYWLTPDGGYVNDTGCGNTLRLDKPQGVAWVMECLRFWVSECHVDGFRFDLGSVLGRTPAFDRDAPLFQAMLADDLLSRCKLIAEPWDIGPGGYQVGAFPGRFAEWNDHYRDDIRRFWLQGDIPLGQFAQRFAGSSDLFNQRGRAPYAGINMLTAHDGFTLQDLVSFNRKHNQLNGEGNRDGSDHNFSYNHGVEGPIANDAIVQRRRASRQALLATLLLSQGTPMLLAGDEHGHSQQGNNNAYCQDNAITWLDWAKADDSLTAYTAALIHLRRQIPALQQDRWWQEGDGSVQWLNAQGLPLAAQEWEQGNLQLQIRLSQRWLVVVNATPQAAEMRLPAGDWQVVAPFTQEGSRAVLPAWNQAAHSICVLVQK

SEQ ID NO: 4179 - protein, 660 aa, Serratia sp.
MTELTPGIAAPLGAHYDGNGINFTLFSAHATGVELCLFDGQQREVRLPLPARSGDIWHGYLPGGKPGQRYGYRVHGQFDPAQGLRFNPNKLLLDPAARAVEGPVADDLELHGGYDRPDPQDSAEVMPKCVVIDEAYDWQDDRPPATPWGKTVIYEAHVRGLTLLHPDIPPVLRGSFAALGHPVMIAHFKRLGITALELLPVQQHSSEPRLQRLGLINYWGYNVLAPYAPDNRYCSLRTDMTPLREFRDAVKALHKAGIEVILDVVFNHSAELDMDGPTLSLRGIDNPEYYWLAPDGGYVNDTGCGNTLRLDKPQGVAWVMECLRFWVSECHVDGFRFDLGSVLGRTPAFDRDAPLFQAMLADDLLSRCKLIAEPWDIGPGGYQVGAFPGRFAEWNDHYRDDMRRFWLQGDLPLGQFAQRFAGSSDVFNQRGRAPYASINMLTAHDGFTLQDLVSFNRKHNQLNGEGNRDGSDHNFSYNHGVEGPIADDAIVQRRRASRQALLATLLLSQGTPMLLAGDEHGHSQQGNNNAYCQDNAITWLDWAKADDSLTAYTAELIHLRRQIPALQQDRWWQEGDGSVQWLNAQGHPPAAQEWEQGDLQLQIRLSQRWLVVVNATPQTVEMRLPAGDWQVVAPFTQEGPQAVLPAWNQAAHSICVLVQK

SEQ ID NO: 4180 - protein, 661 aa, Serratia sp.
MTELTPGIAAPLGAHYDGNGINFSLYSAHATGVELCLFDEQQREVRLPLATRSGDIWHGYLPGGKPGQRYGYRVHGPFDPAQGLRFNPNKLLLDPAARAVEGPVADDPYLHGGYDRPDRHDSAELMPKCVVIDEAYDWQDDCPPATPWGKTVIYEAHVRGLTLQHPDIPQVLRGSFAALGHPVMIAYFKRLGITALELLPVQQHSSEPRLQRLGLINYWGYNVLAPYAPDNRYSSLRTDMTPLREFRDAVKALHKAGIEVILDVVFNHSAELDTDGPTLSLRGIDNPGYYWLTPEGGYVNDTGCGNTLRLDQPQGVAWVMDCLRFWVGECHVDGFRFDLGSVLGRTPAFDRDAPLFQAMLADDLLSRCKLIAEPWDIGPGGYQVGEFPGRFAEWNDHYRDDMRRFWLQGDISLGQFAQRFAASSDLFNQRGRAPYASINMLTAHDGFTLQDLVSFSRKHNQLNGEGNRDGSDRNFSNNHGVEGPIADDAIVQRRRASRQVLLATLLLSQGTPMLLAGDEHGHSQQGNNNAYCQDNAITWLDWATADDSLTAYTAALIHLRQQIPALQHDRWWQEGDGNVQWLNAQGQSLSAQQWEQGDLQLQICLSQRWLVVVNATQQAVEMTLPAGDWQLVAPFTQEDSRAVLPAWNQAAHSICVLVKKK

SEQ ID NO: 4181 - protein, 660 aa, Serratia sp.
MTELTPGIAAPLGAHYDGNGINFSLYSSHATGVELCLFDEQQREIRLPLTTRSGDIWHGYLPGGKPGQRYGYRVHGPFDPAQGLRFNPNKLLLDPAARAVEGPVADDPYLHGGYDRPDQHDSAGLMPKCVVIDEVYDWQDDRPPATPWGKTVIYEAHVRGLTLQHPDIPQVLRSSFAALGHPVMIAYFKRLGITALELLPVQQHSSEPRLQRLGLINYWGYNVLAPFAPDNRYSSLRADMTPLREFRDAVKALHKAGIEVILDVVFNHSAELDMDGPTLSLRGIDNPGYYWLTPDGDYVNDTGCGNTLRLDQPQGVAWVMDCLRFWVGECHVDGFRFDLGSVLGRTPAFDRDAPLFQAMLADDLLSRCKLIAEPWDIGPGGYQVGEFPGRFAEWNDHYRDDMRRFWLQGDVSLGQFAQRFAASSDLFNRRGRAPYASINMLTAHDGFTLQDLVSFNRKHNQLNGEGNRDGSDRNFSNNHGVEGPIADDTIVQHRRASQRALLATLLLSQGTPMLLAGDEHGHSQQGNNNAYCQDNAITWLDWAAADDSLTTYTAALIRLRQQIPALQQDRWWQEGDGSVQWLNAQGQSLGAQQWEQGTLQLQIRLSQRWLVVVNATQQAVEMTLPEGDWQLVAPFTQEDSRAVLPVWNQAAHSICVLVKK

SEQ ID NO: 4182 - protein, 661 aa, Multievos46 sp.
MTELTPGIAAPLGAHYDGNGINFSLYSARATGVELCLFDEQQQEVRLPLTVRSGDIWHGYLPGGKPGQRYGFRVYGPFDPAQGLRFNPNKLLLDPAARAVEGPVADDPYLHGGYDRPDQHDSAELMPKCVVIDEAYDWQDDRPPATPWGKTVIYEAHVRGLTLQHPEIPPVLRGSFAALGHPVMIAYFKRLGITALELLPVQQHSSEPRLQRLGLINYWGYNVLAPFAPDNRYSSLRTDTTPLREFRDAVKALHKAGIEVILDVVFNHSAELDTDGPTLSLRGIDNPGYYWLTPDGDYVNDTGCGNTLRLDQPQGVAWVMDCLRFWVGECHVDGFRFDLGSVLGRTPAFDRDAPLFQAILADDLLSRCKLIAEPWDIGPGGYQVGQFPGRFAEWNDHYRDDIRRFWLQDGISLGQFAQRFAASSDLFNQRGRAPYASINMLTAHDGFTLQDLVSFNRKHNQLNGEGNRDGSDRNFSNNHGVEGPIADDAILQRRRASRRALLATLLLSQGTPMLLAGDEHGHSQQGNNNAYCQDNAITWLDWATADDALTDYTAALIRLRQQIPALQQDRWWQEGDGSVQWLNAQGQPLDAQEWEQGELRLQICLSQRWLVVVNATQQAVEMTLPVGDWQLVAPFTQEDSRAVLPAWHQAAHSICVLVKKK

SEQ ID NO: 4183 - protein, 661 aa, Serratia sp.
MTELTPGIAAPLGAHYDGNGINFSLYSARATGVELCLFDEQQQEVRLLLTARSGDIWHGYLPGGKPGQRYGFRVHGPFDPAQGLRFNPNKLLLDPAARAVEGPVADDPYLHGGYDRPDQHDSAELMPKCVVIDEAYDWQDDRPPATPWGKTVIYEAHVRGLTLQHPEIPPVLRGSFAALGHPVMIAYFKRLGITALELLPVQQHSSEPRLQRLGLINYWGYNVLAPFAPDNRYSSLRTDTTPLREFRDAVKALHKAGIEVILDVVFNHSAELDTDGPTLSLRGIDNPGYYWLTPDGDYVNDTGCGNTLRLDQPQGVAWVMDCLRFWVGECHVDGFRFDLGSVLGRTPAFDRDAPLFQAILADDLLSRCKLIAEPWDIGPGGYQVGQFPGRFAEWNDHYRDDIRRFWLQDGISLGQFAQRFAASSDLFNQRGRAPYASINMLTAHDGFTLQDLVSFNRKHNQLNGEGNRDGSDRNFSNNHGVEGPIADDAILQRRRASRRALLATLLLSQGTPMLLAGDEHGHSQQGNNNAYCQDNAITWLDWATADDALTDYTAALIRLRQQIPALQQDRWWQEGDGSVQWLNAQGQPLDAQEWEQGELRLQICLSQRWLVVVNATQQAVEMTLPVGDWQLVAPFTQEDSRAVLPAWHQAAHSICVLVKKK

SEQ ID NO: 4184 - protein, 661 aa, unknown
  environmental sample
MTELTPGIAAPLGARYDGNGINFSLYSARATGVELCLFDEQQQEVRLPLTARSGDIWHGYLPGGKPGQRYGFRVHGPFDPAQGLRFNPNKLLLDPAARAVEGPVADDPYLHGGYDRPDQHDSAELMPKCVVIDEAYDWQDDRPPATPWGKTVIYEAHVRGLTLQHPEIPPVLRGSFAALGHPVMIAYFKRLGITALELLPVQQHSSEPRLQRLGLINYWGYNVLAPFAPDNRYSSLRTDTTPLREFRDAVKALHKAGIEVILDVVFNHSAELDTDGPTLSLRGIDNPGYYWLTPDGDYVNDTGCGNTLRLDQPQGVAWVIDCLRFWVGECHVDGFRFDLGSVLGRTPAFDRDAPLFQALLADDLLSRCKLIAEPWDIGPGGYQVGQFPGRFAEWNDHYRDDIRRFWLQDGISLGQFAQRFAASSDLFNQRGRAPYASINMLTAHDGFTLQDLVSFNRKHNQLNGEGNRDGSDRNFSNNHGVEGPIADDAILQRRRASRRALLATLLLSQGTPMLLAGDEHGHSQQGNNNAYCQDNAITWLDWATADDALTDYTAALIRLRQQIPALQQDRWWQEGDGSVQWLNAQGQPLDAQEWEQGELRLQICLSQRWLVVVNATQQAVEMTLPVGDWQLVAPFTQEDSRAVLPAWHQAAHSICVLVKKK

SEQ ID NO: 4185 - protein, 660 aa, Serratia sp.
MTELTAGLAAPLGAHYDGEGINFTLYSAHAERVELCLFDGQQREVRLPLPARSGDIWHGYLPGGRPGQRYGYRVYGPFDPANGPRFNPNKLALDPAARAVEGPVADHPHLHGGYEQPDPHDSAELMPKCVVVDEQYDWQDDRPPATPWGQTVIYEAHVRGLTLLHPKIPPALRGSFAALGHPVMIAHFKRLGITALELLPVQQHTSEPRLQRLGLINYWGYNVLAPYAPDNRYASLSTDGTPLNEFRDAVKALHQAGIEVILDVVFNHSAELDMDGPMLSLSGIDNLSYYWLTPEGDYVNDTGCGNTLRLDQPQGVAWVMDCLRFWVRECHVDGFRFDLGSVLGRTPGFDRDAPLFQTMLADDLLSRCKLIAEPWDVGPGGYQVGAFPGRFAEWNDHYRDDMRRFWLQSGVSLGQFARRFAASSDLYNQRGRAPYATVNMLTAHDGFTLQDVVSFNEKHNQPNGEGNRDGSDRNFSNNHGVEGLVADDAIVQRRRASQRAMLATLLLSQGTPMLLAGDEQGHSQQGNNNAYCQDNAITWLDWATADDALTDYVAALIALRRQIPALQQDRWWQQDDGSVQWLNAQGQPLDAQQWEQGDLLMQILLSQRWLLLVNATPQTVEMRLPEGDWQVVAPFTQEDSRAVLPAWHQDARSLCVLVRK

SEQ ID NO: 4186 - protein, 660 aa, Serratia sp.
MTELTAGLAAPLGAHYDGEGINFTLYSAHAERVELCLFDGQQREVRLPLPARSGDIWHGYLPGGRPGQRYGYRVYGPFDPANGQRFNPNKLALDPAARAVEGPVADHPHLHGGYEQPDPHDSAELMPKCVVVDEQYDWQDDRPPATPWGQTVIYEAHVRGLTLLHPKIPPALRGSFAALGHPVMIAHFKRLGITALELLPVQQHTSEPRLQRLGLINYWGYNVLAPYAPDNRYASLSTDGTPLNEFRDAVKALHQAGIEVILDVVFNHSAELDRDGPMLSLSGIDNQSYYWLTPEGDYVNDTGCGNTLRLDQPQGVAWVMDCLRFWVRECHVDGFRFDLGSVLGRTPGFDRDAPLFQAMLADDVLSRCKLIAEPWDVGPGGYQVGAFPGRFAEWNDHYRDDMRRFWLQSGVSLGQFARRFAASSDLYNQRGRAPYATVNMLTAHDGFTLQDVVSFNEKHNQPNGEGNRDGSDRNFSNNHGVEGLVADDAIVQRRRASQRAMLATLLLSQGTPMLLAGDEQGHSQQGNNNAYCQDNATTWLDWATADDALTDYVAALIALRRQIPALQQDRWWQQDDGSVQWLNAQGQPLDAQQWEQGDLLMQILLSQRWLLLVNATPQTVEMRLPEGDWQVVAPFTQEDSRAVLPAWHQAARSLCVLVRK

SEQ ID NO: 4187 - protein, 660 aa, Serratia sp.
MTELTAGLAAPLGAHYDGEGINFTLYSAHAERVELCLFDGQQREVRLPLPARSGDIWHGYLPGGRPGQRYGYRVYGPFDPANGQRFNPNKLALDPAARAVEGPVADHPHLHGGYEQPDPHDSAELMPKCVVVDEQYDWQDDRPPATPWGQTVIYEAHVRGLTLLHPKIPPALRGSFAALGHPVMIAHFKRLGITALELLPVQQHTSEPRLQRLGLINYWGYNVLAPYAPDNRYASLSTDGTPLNEFRDAVKALHQAGIEVILDVVFNHSAELDRDGPMLSLSGIDNQSYYWLTPEGDYVNDTGCGNTLRLDQPQGVAWVMDCLRFWVRECHVDGFRFDLGSVLGRTPGFDRDAPLFQAMLADDVLSRCKLIAEPWDVGPGGYQVGAFPGRFAEWNDHYRDDMRRFWLQSGVSLGQFARRFAASSDLYNQRGRAPYATVNMLTAHDGFTLQDVVSFNEKHNQPNGEGNRDGSDRNFSNNHGVEGLVADDAIVQRRRASQRAMLATLLLSQGTPMLLAGDEQGHSQQGNNNAYCQDNATTWLDWATADDALTDYVAALIALRRQIPALQQDRWWQQDDGNVQWLNAQGQPLDAQQWEQGDLLMQILLSQRWLLLVNATPQTVEMRLPEGDWQVVAPFTQEDSRAVLPAWHQAARSLCVLVRK

SEQ ID NO: 4188 - protein, 660 aa, Serratia sp.
MTELTAGLAAPLGAQYDGEGINFTLYSAHAERVELCLFDGQQREVRLPLPARSGDIWHGYLPGGKPGQRYGYRVYGPFDPANGQRFNPNKLALDPAARAVEGPVADHPHLHGGYEQPDPHDSAELMPKCVVVDERYDWQDDRPPATPWGQTVIYEAHVRGLTLLHPQIPPALRGSFAALGHPAMIAHFKRLGITALELLPVQQHTSEPRLQRLGLINYWGYNVLAPYAPDNRYASLSTDATPLNEFRDAVKALHQAGIEVILDVVFNHSAELDRDGPMLSLSGIDNLSYYWLTPEGDYVNDTGCGNTLRLDQPQGVAWVMDCLRFWVRECHVDGFRFDLGSVLGRTPGFDRDAPLFQAMLADDLLSRCKLIAEPWDIGPGGYQVGAFPGRFAEWNDHYRDDMRRFWLQSGVSLGQFARRFAASSDLYNQRGRAPYATVNMLTAHDGFTLQDVVSFNEKHNQPNGEGNRDGSDRNFSNNHGVEGLVADDAIVQRRRASQRAMLATLLLSQGTPMLLAGDEQGHSQQGNNNAYCQDNATTWLDWATADDALTDYVAALIALRRQIPALQQDRWWQQDDGSVQWLNAQGQPLDAQQWERGELLMQILLSQRWLLLVNATPQTTEMRLPEGDWQVVAPFTQEDSRAVLPAWHQAARSLCVLVRK

SEQ ID NO: 4189 - protein, 660 aa, Serratia sp.
MTELTAGLAAPLGAQYDGEGINFTLYSAHAERVELCLFDGQQREVRLPLPARSGDIWHGYLPGGKPGQRYGYRVYGPFDPANGQRFNPNKLALDPAARAVEGPVADHPHLHGGYEQPDPHDSAELMPKCVVVDERYDWQDDRPPATPWGQTVIYEAHVRGLTLLHPQIPPALRGSFAALGHPAMIAHFKRLGITALELLPVQQHTSEPRLQRLGLINYWGYNVLAPYAPDNRYASLSTDATPLNEFRDAVKALHQAGIEVILDVVFNHSAELDRDGPMLSLSGIDNLSYYWLTPEGDYVNDTGCGNTLRLDQPQGVAWVMDCLRFWVRECHVDGFRFDLGSVLGRTPGFDRDAPLFQAMLADDLLSRCKLIAEPWDIGPGGYQVGAFPGRFAEWNDHYRDDMRRFWLQSGVSLGQFARRFAASSDLYNQRGRAPYATVNMLTAHDGFTLQDVVSFNEKHNQPNGEGNRDGSDRNFSNNHGVEGLVADDAIVQRRRASQRAMLATLLLSQGTPMLLAGDEQGHSQQGNNNAYCQDNATTWLDWATADDALTDYVAALIALRRQIPALQQDRWWQQDDGSVQWLNAQGQPLDAQQWERGERLMQILLSQRWLLLVNATPQTTEMRLPEGDWQVVAPFTQEDSRAVLPAWHQAARSLCVLVRK

SEQ ID NO: 4190 - protein, 660 aa, Serratia sp.
MTELTAGRAAPLGAHYDGEGINFTLYSAHAERVELCLFDGQQREVRLPLPARSGDIWHGYLPGGKPGQRYGYRVYGPFDPANGQRFNPNKLALDPAARAVEGPVADHPHLHGGYDRPDPHDSAELMPKCVVVDQCYDWQDDRPPATPWGQTVIYEAHVRGLTLLHPKLPPALRGSFAALGHPVMIAHFKRLGITALELLPVQQHTSEPRLQRLGLINYWGYNVLAPYAPDNRYASLSTDGTPLNEFRDAVKALHQAGIEVILDVVFNHSAELDMDGPMLSLSGIDNQSYYWLTPEGDYVNDTGCGNTLRLDQPQGVAWVMDCLHFWVRECHVDGFRFDLGSVLGRTPGFDRDAPLFQAMLADDVLSRCKLIAEPWDVGPGGYQVGAFPGRFAEWNDHYRDDMRRFWLQSGVSLGQFARRFAASSDVYNQRGRAPYATVNMLTAHDGFTLQDVVSFNEKHNQPNGEGNRDGSDRNFSNNHGVEGLVADDAIVQRRRASQRAMLATLLLSQGTPMLLAGDEQGHSQQGNNNAYCQDNATTWLDWSTADDALTDYVAALIALRRRIPALQQDRWWQQDDGSVQWLNAQGQVLDAQQWEQGDLFMQILLSQRWLLLVNATPQTVEMRLPEGDWQVVAPFTQEDSRAVLPAWHQDARSLCVLVRK

SEQ ID NO: 4191 - protein, 660 aa, unknown
  environmental sample
MTELTAGLAAPLGAQYDGEGINFTLYSAHAERVELCLFDGQQREVRLPLPARSGDIWHGYLPGGRPGQRYGYRVYGPFDPANGQRFNPNKLALDPAARAVEGPVADHPHLHGGYEQPDPHDSAELMPKCVVVDEQYDWQDDRPPATPWGQTVIYEAHVRGLTLLHPQIPPALRGSFAALGHPAMIAHFKRLGITALELLPVQQHTSEPRLQRLGLINYWGYNVLAPYAPDNRYASLSTDATPLNEFRDAVKALHQAGIEVILDVVFNHSAELDRDGPMLSLSGIDNLSYYWLTPEGDYVNDTGCGNTLRLDQPQGVAWVMDCLHFWVRECHVDGFRFDLGSVLGRTPGFDRDAPLFQAMLADDLLSRCKLIAEPWDVGPGGYQVGAFPGRFAEWNDHYRDDMRRFWLQSGVSLGQFARRFAASSDLYNQRGRAPYATVNMLTAHDGFTLQDVVSFNEKHNQPNGEGNRDGSDRNFSNNHGVEGLVADDAIVQRRRASQRAMLATLLLSQGTPMLLAGDEQGHSQQGNNNAYCQDNATTWLDWATADDALTDYVAALIALRRQIPALQQDRWWQQDDGSVQWLNAQGQPLDAQQWERGELLMQILLSQRWLLLVNATPQTTEMRLPEGDWQVVAPFTQEDSRAVLPAWHQAARSLCVLVRK

SEQ ID NO: 4192 - protein, 660 aa, Serratia sp.
MTELTAGLAAPLGAHYDGEGINFTLYSAHAERVELCLFDGQQREVRLPLPARSGDIWHGYLPGGRPGQRYGYRVYGPFDPANGQRFNPNKLALDPAARAVEGPVADHPHLHGGYEQPDPHDSAELMPKCVVVDEQYDWQDDRPPATPWGQTVIYEAHVRGLTLLHPQIPPALRGSFAALGHPAMIAHFKRLGITALELLPVQQHTSEPRLQRLGLINYWGYNVLAPYAPDNRYASLSTGATPLNEFRDAVKALHKAGIEVILDVVFNHSAELDMDGPMLSLSGIDNLSYYWLTPEGDYVNDTGCGNTLRLDQPQGVAWVMDCLRFWVRECHVDGFRFDLGSVLGRTPGFDRDAPLFQAMLADDVLSRCKLIAEPWDIGPGGYQVGAFPGRFAEWNDHYRDDMRRFWLQSGVSLGQFARRFAASSDLYNQRGRAPYATVNMLTAHDGFTLQDVVSFNEKHNQPNGEGNRDGSDRNFSNNHGVEGLVADYAIVQRRRASQRAMLATLLLSQGTPMLLAGDEQEHSQQGNNNAYCQDNATTWLDWATADDALTDYVAALIALRRQIPALQQDRWWQQDDGSVQWLNAQGQALDAQQWEQGEPLMQILLSQRWLLLINATPQTTEMRLPEGDWQVVAPFTQEDSRAVLPAWHQAARSLCVLVRK

SEQ ID NO: 4193 - protein, 660 aa, Serratia sp.
MTELTTGLAAPLGAHYDGEGINFTLYSAHAERVELCLFDGQQREVRLPLPARSGDVWHGYLPGGKPGQRYGYRVYGPFEPASGLRFNPNKLSLDPAARAVDGPVADHPHLHGGYDQPDPHDSAELMPKCVVVDEHYDWQDDCPPDTPWGQTVIYEAHVRGLTLLHPAIPPALRGSFAALGHPVMIAYFKRLGITALELLPVQQHTSEPRLQRLGLINYWGYNVLAPYAPDNRYASLRTEGTPLNEFRDAVKALHKAGIEVIIDVVFNHSAELDMDGPMLSLSGIDNPSYYWLTPEGDYVNDTGCGNTLRLDQPQGVAWVMDCLHFWVRECHVDGFRFDLGSVLGRTPGFDRDAPLFQAMLADDLLSRCKLIAEPWDIGPGGYQVGAFPGRFAEWNDHYRDDMRRFWLQSGVSLGQFARRFAASSDLYNQHGRAPYATVNMLTAHDGFTLQDVVSFNEKHNQLNGEGNRDGSDRNFSNNHGVEGLVADDAIVQRRRASQRAMLATLLLSQGTPMLLAGDEQGHSQQGNNNAYCQDNATTWLDWSTADDALTDYVAALIALRRQIPALLQDSWWQQDDGSVQWLNAQGQPLDAQQWEQGELYMQILLSQRWLLLVNATSQTVEMKLPAGDWHVVAPFIQEDSRAVLPAWHQAARSLCVLVRK

SEQ ID NO: 4194 - protein, 662 aa, Serratia sp.
MIVLTPGTAAPLGAHYDGNGINFTLFSAHATQVELCLFDAQHRETRLPLPARSGDIWHGYLPGGEPGQRYGFRVHGPFEPQQGLRFNANKLLLDPAARAVEGPVADHLYLHGGYDQPDSEDSAPLMPKCIVIDERYDWEDDRPPATPWSKTVVYEAHVRGLTLLHPDIPPVLRGSFAALGHPVMIAYFKRLGITALELLPVQQHTTEPRLQRLGLINYWGYNVLAPYAPDNRYASLRTGMTPLRELRDAVKALHKAGIEVILDVVFNHSAELDIDGPTLSLRGIDNPSYYWLEPEGGYVNATGCGNTLRLDQPAGVTWVMDCLRFWVRECHVDGFRFDLGTVLGRTPAFDRDAPLFQAMLADDTLGRCKLIAEPWDIGPGGYQVGAFPGRFAEWNDHFRDDIRRFWLQGDLSLGQFARRFAASSEVFNQRGRAPYTSINMLAAHDGFTLQDVVSFNQKHNQLNGEGNRDGSDHNFSYNHGVEGPSADNAIIQRRRASQRALLATLLLAQGTPMLLAGDEHGHSQQGNSNAYCQDNETTWLDWATADDSLTAYTAALIRLRQQIPALQRDGWWQEGDGSVQWLNVHGQPLSAQEWEQGDRLLQIRLSQRWLLVINATPQAVEMTLPEGTWQAVAPFIQDDSQAVLPAWCQAAHSLCVLVKKNN

SEQ ID NO: 4195 - protein, 660 aa, Serratia sp.
MTELTAGLAAPLGAHYDGEGINFTLYSAHAERVELCLFDGQQREVRLPLPARSGDIWHGYLPGGRPGQRYGYRVYGPFDPTNGQRFNPNKLALDPAARAVEGPVGDHPHLHGGYEQPDPHDSAELMPKCVVVDERYDWQDDRPPATPWGQTVIYEAHVRGLTLLHPKIPPALRGSFAALGHPAMVAHFKRLGITALELLPVQQHTSEPRLQRLGLINYWGYNVLAPYAPDNRYASLSTEGTPLNEFRDAVKALHQAGIEVILDVVFNHSAELDRDGPMLSLSGIDNLSYYWLTPEGDYVNDTGCGNTLRLDQPQGVAWVMDCLRFWVRECHVDGFRFDLGSVLGRTPEFDRDAPLFQAMLADDVLSRCKLIAEPWDVGPGGYQVGAFPGRFAEWNDHYRDDMRRFWLQSGVSLGQFARRFAASSDLYNQRGRAPYATVNMLTAHDGFTLQDVVSFNEKHNQPNGEGNRDGSDRNFSNNHGVEGLVADDAIVQRRRASQRAMLATLLLSQGTPMLLAGDEQGHSQQGNNNAYCQDNATTWLDWATADDALTDYVAALIALRRQIPALQQDRWWQQDDGSVQWLNAQGQALDAQQWEQGEPLMQILLSQRWLLLINATPQTTEMRLPEGDWQVVAPFTQEDSRAVLPAWHQAARSLCVLVRK

SEQ ID NO: 4196 - protein, 661 aa, Serratia sp.
MVELTPGLAAPLGAYYDGNGINFTLFSAHATQVELCLFDAQYRETRLPLPARSGDIWHGYLPGGELGQRYGFRVHGPFEPHLGLRFNANKLLLDPAARAVEGPVADHVHLHGGYDQPDPQDSAPLMPKCIVIDESYDWQDDRPPATPWGKTVIYEAHVRGLTLTHPEIPAVLRGSFAALGHPAMIAYFKRLGITALELLPVQQHTTEPRLQRLGLINYWGYNVLAPFAPDNRYSSLSTGTTPLREFRDAVKALHRAGIEVILDVVFNHSAELDVDGPTLSLRGIDNPSYYWLTPDGGYDNLTGCGNTLRLDQPAGVAWVMDCLRFWVRECHVDGFRFDLGTVLGRTPAFDRDAPLFQAMLADDTLGRCKLIAEPWDIGPGGYQVGAFPGRFAEWNDHFRDDIRRFWLRGDLSLGQFAQRFAASSEVFNQRGRAPYVSINMLTAHDGFTLQDVVSFKEKHNQPNGEGNRDGSDQNFSCNHGVEGLIADETVLQRRQASQRALLATLLLAQGTPMLLAGDEHGNSQQGNNNAYCQDNATTWLDWANADESLTAYTAALIRLRQQIPALQADRWWQEGDGSVQWLNAQGQPLSAQQWEQGDRCLQIRLSQRWLMVINATQQTVEMTLPEGDWQVVAPFTQEDSRAVLPALCQVAHSLCVLVEKN

SEQ ID NO: 4197 - protein, 661 aa, Serratia sp.
MVELTPGLAAPLGAYYDGNGINFTLFSAHATQVELCLFDAQYRETRLPLPARSGDIWHGYLPGGELGQRYGFRVHGPFEPHLGLRFNANKLLLDPAARAVEGPVADHVHLHGGYDQPDPQDSAPLMPKCIVIDESYDWQDDRPPATPWGKTVIYEAHVRGLTLTHPEIPAVLRGSFAALGHPAMIAYFKRLGITALELLPVQQHTTEPRLQRLGLINYWGYNVLAPFAPDNRYSSLSTGTTPLREFRDAVKALHRAGIEVILDVVFNHSAELDVDGPTLSLRGIDNPSYYWLTPDGGYDNLTGCGNTLRLDQPAGVAWVMDCLRFWVRECHVDGFRFDLGTVLGRTPAFDRNAPLFQAMLADDTLARCKLIAEPWDIGPGGYQVGAFPGRFAEWNDHFRDDIRRFWLRGDLSLGRFAQRFAASSEVFNQRGRAPYVSINMLTAHDGFTLQDVVSFKEKHNQPNGEGNRDGSDQNFSCNHGVEGLIADETVLQRRQASQRALLATLLLAQGTPMLLAGDEHGNSQQGNNNAYCQDNATTWLDWANADESLTAYTAALIRLRQQIPALQADRWWQEGDGSVQWLNAQGQPLSAQQWEQGDRCLQIRLSQRWLMVINATQQTVEMTLPEGDWQVVAPFTQEDSRAVLPAWCQVAHSLCVLVEKN

SEQ ID NO: 4198 - protein, 661 aa, Serratia sp.
MIELTPGLAAPLGACYDGNGINFTLFSAHATQVELCLFDAQHRETRIPLPARSGDIWHGYLPGGEPGQRYGFRVHGPFEPHKGRRFNANKLLLDPAARAVEGPVADHLHLHGGYDHPDPQDSAPLMPKCVVIDQRYDWEDDRPPATPWSQTVIYEAHVRGLTLLHPEIPAVLRGSFAAIGHPVMIAYFKRLGITALELLPVQQHTTEPRLQRLGLINYWGYNVLAPYAPDNRYCSLSTDMTPLREFRDAVKALHKAGIEVILDVVFNHSAELDVDGPTLSLRGIDNESYYWLTPEGDYDNVTGCGNTLRLDQPVGVAWVMDCLRFWVHECHVDGFRFDLGTVLGRTPAFDRDAPLFQAMLADDTLGRCKLIAEPWDIGPGGYQVGAFPGRFAEWNDHFRDDIRRFWLQNDLSLGRFAQRFAASSEVFNQRGRAPYASINMLTAHDGFTLQDVVSFNEKHNQPNGEGNRDGSDRNFSCNHGIEGLIADDTVLQHRKASQRALLATLLLAQGTPMLLAGDEHGHSQQGNNNAYCQDNETTWLDWAKADDSLTAYTAALIRLRQQIPALREDRWWQEGDGSVQWLNAQGQPLSVQEWEQGDRHMQIRLSQHWLLVINATQQAVEMTLPEGDWQVVAPFTQDDSRAVSPVWCQAAHSLCVLAEKN

SEQ ID NO: 4199 - protein, 661 aa, Serratia sp.
MVELTPGLAAPLGACYDGNGINFTLFSAHATQVELCLFDAQYRETRLPLPARSGDIWHGYLPGGEPGQRYGFRVHGPFEPHLGLRFNANKLLLDPAARAVEGPVADHVHLHGGYDQQDPQDSAPLTPKCVVIDESYDWQDDRPPATPWGKTVIYEAHVRGLTLTHPEIPAVLRGSFAALGHPAMIAYFKRLGITALELLPVQQHTTEPRLQRLGLINYWGYNVLAPFAPDNRYSSLSTGTTPLREFRDAVKALHRAGIEVILDVVFNHSAELDVDGPTLSLRGIDNTSYYWLTPDGDYDNLTGCGNTLRLDQPAGVAWVMDCLRFWVRECHVDGFRFDLGTVLGRTPAFDRDAPLFQAMLADDTLGRCKLIAEPWDIGPGGYQVGEFPGRFAEWNDHFRDDIRRFWLRNDLTLGQFAQRFAASSEVFNQRGRAPNASINMLTAHDGFTLQDVVSFKEKHNQPNGEGNRDGSDQNYSCNHGVEGLIADETVLQRRQASQRALLATLLLAQGTPMLLAGDEHGNSQQGNNNAYCQDNETTWLDWANADDSLTAYTAALIRLRQQIPALQADRWWQEGDGSVQWLNAQGQPLSAQQWEQGDRCMQIRLSQRWLMVINATQQAVEMTLPEGDWQVVAPFTQEPSQAVLPAWCQAAHSLCVLVENN

SEQ ID NO: 4200 - protein, 658 aa, Serratia sp.
MRELQPGVAAPYGAHFDGSGVNFVLFSANATRVELCLFDAEQRETRLPLPARSGDIWHGYLPGGRPGLRYAYRVHGPFAPAQGLRFNPQKLLLDPAARAVEGPVDDDPRLHGGYQQADEHDSATLMPKCIVVDETYDWQDDRAPATPWGETVIYEAHVRGLTLQHPAIPPALRGSFAALGHPAMIAYFTHLGITALELLPVQQHTTEPRLQQLGLQNYWGYNVLAPYAPDHRYASQSSPLREFRDAVKALHRAGIEVILDVVFNHSAELDIDGPTLSLRGIDNPSYYWLNPDGDYTNVTGCGNTLRLDQPSGVAWVMDCLRFWARECHVDGFRFDLGTVLGRRPAFDRDAPLFQAMLADDTLSRCKLIAEPWDIGPGGYQVGGVPGRFAEWNDHYRDDMRRFWLLGDLPLGAFAQRFAASSEVFDRRGRAPYASVNMLTAHDGFTLQDLVSYNQRHNQPNGEDNRDGNGRNYSYNHGVEGPTDDAEVRQRRGRSQRALLATLLLSQGTPMLLAGDEHGHSQHGNNNAYCQDNATTWLDWQSADRALLDYTAALIRLRRQIPALRQDRWWQEGDGCVQWLNAQGQPLGASQWEHAPPQLQIRLSQRWLVVINAGPETVDMTLPAGDWQLVTPFVQEDSQADLPAWRQPAHSLCVLADNN

SEQ ID NO: 4201 - protein, 667 aa, Serratia sp.
MMDLMPGLAAPLGAYYDGNGINFTLFSAHATGVELCLFDEQHRETRIPLPARSGDIWHGYLPGGRPGLRYGYRVHGPFKPQQGLRFNANKLLLDPAARSVEGPVADHPSLHGGHDLPDPHDSAALMPKCIVIDESYDWQDDRPPVTPWSKTVLYEAHVRGLTLLHPQIPEELRGSFAALGHPVMINYFKRLGITALELLPIQQHTTEPRLQRMELTNYWGYNVLAPYAPNNRYCSLSSKMTPLREFRDAVKALHKAGIEVILDVVFNHSAELDAYGPTLSFRGIDNLSYYWLTADGDFENVTGCGNTLRLDQPAGVAWVMDCLRFWVRECHVDGFRFDLGTVLGRIPEFERDAPLFQAMLADDTLGRCKLIAEPWDIGPEGYQLGAFPGRFAEWNDHFRDDIRSFWLKNDRPLGQFAQRFAASSDIFDLRGRAPYACINLLAAHDGFTLRDAVSFNHKHNQLNGENNRDGHDYNFSNNHGVEGNGVEGLIADQAVLQRRRNSQRVLLATLLLAQGTPMLLAGDEHGHSQQGNNNAYCQDNAITWLDWAKADDSLTEYTAALIRLRQQIPALQGGTWWQEGDGNVQWLNAQGQPLKVQEWEDLDGQHIQILLSQHWLLLINATAKAVEMTLPEGDWQPVPPFTQEYSLVDLPSWCQVAHSLCVLARKN

SEQ ID NO: 4202 - protein, 117 aa, Streptomyces sp.
MFSRTMNTVRTTAMALAAATAFTLVGPAGSASAIDHVTCDPDRGYLKIWSHLNGRDSVDCYANRGKTNFGNWWVDKISTGNNVVKYYDANGDVVKIGRNKVISYPNRPPKVKAIEIL

SEQ ID NO: 4203 - protein, 112 aa, Streptomyces sp.
MNTVRATAMALAAATAFTLVGPAGSASAIDHVTCDPGRGYLKIWSHLNGRDSVDCYANRGKTNFGNWWVDKISTGNNVVKYYDANGDVVKIGRNKVISYPNRPPKVKAIEIL

SEQ ID NO: 4204 - protein, 112 aa, Streptomyces sp.
MNTVRTTAMALAAATAFTLVGPAGSASAIDHVTCDPDRGYLKIWSHLNGRDSVDCYANRGKTNFGNWWVDKISTGNNVVKYYDANGDVVKIGRNKVISYPNRPPKVKAIEIL

SEQ ID NO: 4205 - protein, 112 aa, Streptomyces sp.
MNTVRTTAMALAAATAFTLVGPAGSASAIDHVTCDPDRGYLKIWSHLNGRDSVDCYANRGKTNFGNWWVDKISTGNNVVKYYDANGDVVKVGRNKVISYPNRPPKVKAIEIL

SEQ ID NO: 4206 - protein, 106 aa, Streptomyces sp.
MAMALAAAAAFTMTGPATTASAINKVTCNPGAGYLKIWSHMNGRDSVDCYANRGKTNFGNWWVDKISTGNNDVKYYDANGDVVKINRGKTISYPNRPPKVKAIEIL

SEQ ID NO: 4207 - protein, 104 aa, Streptomyces sp.
MALAAATAFTLVGPAGSASAIDHVTCDPGRGYLKIWSHLNGRDSVDCYANRGKTNFGNWWVDKISTGNNVVKYYDANGDVVKIGRNKVISYPNRPPKVKAIEIL

SEQ ID NO: 4208 - protein, 116 aa, Streptomyces sp.
MFSMTRNAPRTLAAALAAAAAFTLGGPVATASAIDHVTCDPDAGFLKIWSHNNGRQSVDCYANRGKTDFGGWWVDQISTGNNDVKYYDANGDVVKIARWSNVKYNNTPKVKAIEIL

SEQ ID NO: 4209 - protein, 106 aa, Streptomyces sp.
MAMALAAATAFTMVGPAGSASAIDHVTCDPDRGYLKVWSHLNGRDSVDCYANRGKTDFGNWWVDKISTGNNVVKYYDANGDVVKIDRNKVISYPNRPPKVKAIEIL

SEQ ID NO: 4210 - protein, 116 aa, Streptomyces sp.
MFSRTRNVPRTLALALAAAAAFTLGGPLTTASAIDHVTCDPDAGFLKIWSHSNGRQSVDCYANRGKTDFGGWWVDQISTGNNDVKYYDANGDVVKIARWSNVKYNNTPKVKAIEIL

SEQ ID NO: 4211 - protein, 157 aa, Streptomyces sp.
MTERNRVPSLLSRAGAVSALSLAAMSTTLVAPGAAPEAAAATHAAKALQIASSKKGSPYRYGATGPRSFDCSGLTLYSYKKAGKKLPRTAAQQHNRTKRISASHRRKGDLVFFHSGGSVYHVGIYAGGGKIWHSPKSGAVVRLEKIWTGSVRYGRVN

SEQ ID NO: 4212 - protein, 157 aa, Streptomyces sp.
MTERNRVPSLLSRAGAVSALSLAAMSTTLVAPGAAPEAAAATHAAKALQVASSKKGSPYRYGATGPRSFDCSGLTLYSYKKAGKKLPRTAAQQHNRTKRISASHRRKGDLVFFHSGGSVYHVGIYAGGGKIWHSPKSGAVVRLEKIWTGSVRYGRVN

SEQ ID NO: 4213 - protein, 157 aa, Streptomyces sp.
MTERNRVPSLLSRAGAVSALSLAAMSTSLVAPGAAPEAAAATHAAKALKIASSKKGSPYRYGATGPRSFDCSGLTLYSYKKAGKKLPRTAAQQHNRTKRISTSNRRKGDLVFFHSGGSVYHVGIYAGGGRIWHSPKSGAVVRLEKIWTGSVRYGRVN

SEQ ID NO: 4214 - protein, 157 aa, Streptomyces sp.
MTALNRVPSLMARAGTASALTIAAVSGSIVAPGFASEAAAATPATKALQIAASKKGSPYRYGATGPHRFDCSGLTLYSFKKAGKKLPRTAAQQYNKTHHISAKNRKAGDLVFFHSGSNVYHVGIYAGKNKLWHSPKSGDVVRLQKIWTKSVWYGRVK

SEQ ID NO: 4215 - protein, 157 aa, Streptomyces sp.
MTALNRVPSLMARVGTASALTIAAMGGSIVAPGFASEAAAATPATKALQIAASKKGSPYRYGATGPHRFDCSGLTLYSFKKAGKKLPRTAAQQYNKTRHISAKNRKAGDLVFFHSGSNVYHVGIYAGKNKLWHSPKSGDVVRLQKIWTKSVWYGRVK

SEQ ID NO: 4216 - protein, 158 aa, Microtetraspora sp.
MTAQMHVPSLLSRAGAVSALTLAAVGGTLLAPGAAPEAQAATTHAAKALSVAAAKKGAPYRYGAAGPSRFDCSGLTLYAYKKAGKSLPRTAQQQYNKTRHISASSRQKGDLVFFHSGGRVYHVGIYAGSGKIWHSPKTGSWVKLDKIWTSKVSYGRVR

SEQ ID NO: 4217 - protein, 157 aa, Streptomyces sp.
MTALNRVPSLMARAGTASALTLAAVGGSIAVPGLATEASAATTATKALQIAASKKGSPYSYGATGPRRFDCSGLTLYSFKKAGKKLPRTAAQQYNRTHHISSGHRKAGDLVFFHSGSSVYHVGIYAGKGKIWHAPKTGDVVRLQKIWTKSVWYGRVN

SEQ ID NO: 4218 - protein, 158 aa, Streptomyces sp.
MTAQMHVPSLLSRAGAVSALTLAAVGGTLLAPGAAPEAQAATAHANKALSVAAAKKGSPYGYGATGPTRFDCSGLTLYAYKKAGKWLPRTAQQQYNKTRHISASSRQQGDLVFFHSGGRVYHVGIYAGGGKIWHSPKTGSWVKLDKIWSSKVYYGRVR

SEQ ID NO: 4219 - protein, 157 aa, Streptomyces sp.
MTALNRVPSLMARAGTASALTLAAVGGSIVIPGAANEASAAALATKALQIAASKKGSPYQWGATGPRRFDCSGLTLYSFKKAGKKLPRTAAQQYNKTRHISARSRRAGDLVFFHSGSNVYHVGIYAGAGKIWHAPHTGTVVKLEKIWTRSVWYGRVN

SEQ ID NO: 4220 - protein, 158 aa, Streptomyces sp.
MTAQMHVPSLLSRAGAVSALTLAAVGGTLLAPGAAPEAQAATTHATKALNVAAAKKGAPYRYGSAGPTRFDCSGLTLYAYKKAGKSLPRTAQQQYNKTRHISASSRQKGDLVFFHSGGRVYHVGIYAGSGKIWHSPKTGSWVKLDKIWTSKVYYGRVR

SEQ ID NO: 4221 - protein, 157 aa, Streptomyces sp.
MTALNRVPSLMVRAGTASALTIAAVGGSIAVPGVASEAAAATPATKALQIAASKKGAPYRYGATGPYRFDCSGLTLYSFKKAGKKLPRTAAQQYNKTRHISAKSRKAGDLVFFHSGRSVYHVGIYAGKGKIWHAPKTGDVVRLQKIWTKSVWYGRVK

SEQ ID NO: 4222 - protein, 158 aa, Streptomyces sp.
MTAQIHVPSLLSRAGAVSALTLAAVGGTMLAPGAVSEAEAAPAHATKALNVAASKKGAPYKYGAAGPSRFDCSGLTLYSYKKAGKTLPRTAQQQYNKTRHLSASSRQKGDLVFFHSGGSVYHVGIYAGGNKIWHSPKSGSVVKLDRIWSKSVYYGRVR

SEQ ID NO: 4223 - protein, 157 aa, Streptomyces sp.
MTALNRVPSLWTRAGTASALTIAAVGGTLVVPGVAPDAEAATVATKALQVAASKKGAPYKWGATGPRRFDCSGLTLYSFKKAGKNLPRTAAAQYNKTHHISASHRKAGDLVFFHSGRSVYHVGIYAGKGKIWHSPKTGDVVKLQKIWTRSVWYGRVS

SEQ ID NO: 4224 - protein, 158 aa, Streptomyces sp.
MTAQTHLPSLLSRTGAVSALTIAAVGGSLIVPGGAPEAHAASAHATKALKVAASKKGAPYGYGATGPNRFDCSGLTLYAYKKAGKKLPRTAQQQYNRTRHISASQRERGDLVFFHSRGYVYHVGIYAGAGKIWHSPKSGSVVKLTKIWSKSVRYGRVR

SEQ ID NO: 4225 - protein, 157 aa, unknown
  environmental sample
MTALNRVPSLLTRAGTASALTIAAVSGSIVVPGAASGAEAATVASKALKVAASKKGSPYKYGAVGPSRFDCSGLTLYSFKKAGKKLPRTAQQQYNKTKHISASSRKLGDLVFFHSGSNVYHVGIYAGKGKIWHSPKTGDVVRLQKLWTKNVWYGRVR

SEQ ID NO: 4226 - protein, 158 aa, Streptomyces sp.
MTAQMHVPSLLSRAGAVSALTLAAVGGTLFAPGAASEAQAATTHANKALTVAASKKGAPYRYGSIGPTRFDCSGLTLYAYKKAGKSLPRTAQQQYNKTRHISSASRQKGDLVFFHSGGRVYHVGIYAGSGKIWHSPKTGSWVKLDKIWSSKVYYGRVR

SEQ ID NO: 4227 - protein, 157 aa, Streptomyces sp.
MTAQVHVPSLLARATTASVLTLAAVGGTLFVPGAMTDAQAATHSMKALNIAASKKGSPYRWGATGPSRFDCSGLTLYSFKKAGKKLPRTAQQQYNKTRHISASKRQRGDLVFFHSGRSIFHVGIYAGSGKIWHSPKTGAVVRLERIWTKSVYYGRVG

SEQ ID NO: 4228 - protein, 159 aa, Streptomyces sp.
MTAQNHVPSAVSRTGAVSALALAALTGTLVAPGAAPEAQAAGPAYATKALNVAASKKGSPYKYGAAGPSRFDCSGLTLYAYKQAGKTLPRTAQQQYNRTRHISASALQKGDLVFFHSGGRVYHVGVYAGSNRIWHAPKAGTVVRLERIWTGKVLYGRVR

SEQ ID NO: 4229 - protein, 161 aa, Streptomyces sp.
MTALHRAPSRVPSLLTRAGTASALTLAAVGGTLVAPGLTSEAEAATHGTKALNIAASKKGSPYRYGAAGPHRFDCSGLTLYSFKRVGKKLPRTAAQQYNKTRHVSAANRTRGDLVFFHSGRNVYHVGIYAGKNKIWHAPKRNTVVRLEKIWTRSVWYGRVR

SEQ ID NO: 4230 - protein, 157 aa, Streptomyces sp.
MTALNRVPSLMVRAGTVSAFAMAAVGGSVVVPGVAADAAAATPATKALKVAASKKGSPYKYGATGPRRFDCSGLTQYSFKKVGKKLPRTAAQQYNKTRHIGAGSRKAGDLVFFHSGSNVYHVGIYAGKGKIWHAPKTGDVVRLQKIWTKSVWYGRVK

SEQ ID NO: 4231 - protein, 157 aa, Streptomyces sp.
MSALNRVPSLMARAGTASALTLAAVGGSIVVPGAAGEAAAATLGTKALKVAASKKGAPYAWGATGPNRFDCSGLTLYSFKKAGKKLPRTAAQQYNKTRHISKSSRKAGDLVFFHSGSYVYHVGIYAGKNKIWHAPKTGDVVRLQKIWTNSVWYGRVK

SEQ ID NO: 4232 - protein, 105 aa, Streptomyces sp.
MALALAAAAAFTLGGPLTTASAIDHVTCDPDAGFLKIWSHMNGRQSVDCYANRGKTDFGGWWVDQISTGNNDVKYYDANGDVVKIARWNNVKYNNTPKVKAIEIL

SEQ ID NO: 4233 - protein, 398 aa, Curtobacterium sp.
MTTTPSTVARARRLPRIAGAVMALALAAGAVVATAEPAAASAVWVGSVPAGTKILPGDQVTSPNGQFKLIMQGDGNLVEYGIGNRVLWASNTAGNSGAIAVVRKDRALDITRNGKRLVRWTSAGTASSTAFKVRADGTMALLAGKAVVVGWTGFQDRVASGNRILGGTVLRSDTSNTRILNMRTDGNLVQKVSGRVVWQSRTGGHPGAWAELQTKGNFVIWTRDASRKKVAIWSSRTSTAGSGNLLVQVDGNVVLYGAKDTRVWSSRPVTGLAWPVNGTKITGRYGDDRGAGHVPRYHQGTDAPVPVGTPVYGSGTGTVTRTVANDGAYGNYIVVTYGMTTVLTAHLSKIEVKQGQIVKLGTEIAKSGNTGQSTGPHVHVETRRNGVLVDPLKNMHFR

SEQ ID NO: 4234 - protein, 341 aa, Pantoea sp.
MTTTPSTVARARRLPRIAGAVTALALAAGALVATAEPAAASAVWVGSAPAGTKILPGDQVTSPNGQFKLIMQGDGNLVEYGIGNRVLWASNTAGNSGAIAVVGKNRALDITKNGKRVARWASAGTVNSTALKVRADGTMALLAGKTVVVSWNGYQDRVPSGNTILGGTVLRSDTSNTRILNMRTDGNLVQKVSGRVVWQSRTGGHPGAWAELQAKGNFVIWTRDASRKKVALWSSRTSTAGSGNLLVQVDGNVVLYGAKDTRVWSSRPVTGLAWPVNGTKITGRYGDDRGAGHVPRYHQGTDAPVPVGTAVYGSGTGTVTKTIANDAAYGNYIVVTYGMTA

SEQ ID NO: 4235 - protein, 427 aa, Bacillus sp.
MVKQGDTLSAIASQYRTTANDITETNEIPNPDSLVVGQTIVIPIAGQFYDVKRGDTLTSIARQFNTTAAELARVNRIQLNTVLQIGFRLYIPPAPKRDIESNAYLEPRGNQVSENLQQAAREASPYLTYLGAFSFQAQRNGTLVAPPLTNLRSITESQNTTLMMIITNLENQAFSDELGRILLNDETVKRRLLNEIVENARRYGFRDIHFDFEYLRPQDREAYNQFLREARDLFHREGLEISTALAPKTSATQQGRWYEAHDYRAHGQIVDFVVLMTYEWGYSGGPPQAVSPIGPVRDVIEYALTEMPANKIVMGQNLYGYDWTLPYTAGGTPARAVSPQQAIVIADQNNASIQYDQTAQAPFFRYTDAENRRHEVWFEDARSIQAKFNLIKELNLRGISYWKLGLSFPQNWLLLSDQFNVVKKTFR

SEQ ID NO: 4236 - protein, 427 aa, Bacillus sp.
MVKQGDTLSAIASQYRTTVSEITETNEIPNPDSLVVGQTIVIPIAGQFYDVKRGDTLTSIARQFNTTAAELARVNRIQLNTVLQIGFRLYIPPAPKRDIESNAYLEPRGNQVSENLQQAAREASPYLTYLGAFSFQAQRNGTLVAPPLTNLRSIAENQNTALMMIITNLENQAFSDELGRILLNDDTVKRRLLNEIVENAKRYGFYDIHFDFEYLRPEDREAYNQFLREARDLFHREGLEISTALAPKTSATQQGRWYEAHDYRAHGQIVDFVVLMTYEWGYSGGPPQAVSPIGPVRDVIEYALTEMPANKIVMGQNLYGYDWTLPYTAGGTPARAISPQQAIVIADQNNAEIQYDQTAQAPFFRYTDAENRRHEVWFEDARSIQAKFNLIKELNLRGISYWKLGLSFPQNWLLLSDQFNVVKKTFR

SEQ ID NO: 4237 - protein, 427 aa, Bacillus sp.
MVKQGDTLSAIASQYRTTVSEIAETNEIPNPDSLVVGQTIVIPIAGQFYDVKRGDTLTSIAQQFNTTAAELARVNRIQLNTVLQIGFRLYIPPAPKRDIESNAYLEPRGNQVSENLQQAAREASPYLTYLGAFSFQAQRDGTLVAPPLTNLRSIAENQNTALMMIITNLENQAFSDELGRILLNDDTVKRRLLNEIVENAKRYGFYDIHFDFEYLRPEDREAYNQFLREARDLFHREGLEISTALAPKTSATQQGRWYEAHDYRAHGQIVDFVVLMTYEWGYSGGPPQAVSPIGPVRDVIEYALTEMPANKIVMGQNLYGYDWTLPYTAGGTPARAISPQQAIVIADQNNAEIQYDQTAQAPFFRYTDAENRRHEVWFEDARSIQAKFNLIKELNLKGISYWKLGLSFPQNWLLLSDQFNVVKKTFR

SEQ ID NO: 4238 - protein, 427 aa, Bacillus sp.
MVKQGDTLSAIASQYRTTVNEITETNEIPNPDSLVVGQTIVIPIAGQFYDVQQGDTLTSIARRFNTTAAELARVNRIQLNTVLQIGFRLYIPPVPKRDIESNAYLEPRGNQVSENLQQAAREASPYLTYLGAFSFQAQRDGTLVAPPLTNLRSIAENQNTTLMMIITNLENQAFSDELGRILLNDDTVKRRLLNEIVENAKRYDFYDIHFDFEYLRPQDREAYNQFLREARDLFHREGLEISTALAPKTSATQQGRWYEAHDYRAHGQIVDFVVLMTYEWGYSGGPPQAVSPIGPVRDVIEYALTEMPANKIVMGQNLYGYDWTLPYTAGGTPARAISPQQALAIADQNNATIQYDQTAQAPFFRYTDAENRGHEVWFEDARSIQAKFNLIKELNLRGISYWKLGLSFPQNWLLLSDQFNIVKKTFR

SEQ ID NO: 4239 - protein, 427 aa, Salinibacillus sp.
MVKQGDTLSAIASQYRTTVSEITETNEIPNPDSLVVGQTIVIPIAGQFYDVQQGDTLTSIAQRFNTTAAELARVNRIQLNTVLQIGFRLYIPPVPKRDIESSAYLEPRGNQVSENLQQAAREASPYLTYLGAFSFQAQRDGTLVAPPLTNLRSIAENQGTTLMMIITNLENQAFSDELGRILLNDDTVKRRLLNEIVENARRYGFRAIHFDFEYLRPQDREAYNQFLREARDLFHQEGLEISTALAPKTSATQQGRWYEAHDYRAHGQIVDFVVLMTYEWGYSGGPPQAVSPIGPVRDVIEYALTEMPANKIVMGQNLYGYDWTLPFTAGGPPARAISPQQAIVIADQNNADIQYDQTAQAPFFRYTDAENKRHEVWFEDARSIQAKFNLIKELNLRGISYWKLGLSFPQNWLLLSDQFQVVKKTFR

SEQ ID NO: 4240 - protein, 426 aa, Bacillus sp.
MKQGDTLTAIASQYRTTVNEITETNEIPNPGSLVVGQTIVIPIAGQFYDVQQGDTLTSIARQFNTTAAELARVNRIQLNTVLQIGFRLYIPPVPKRDIESSAYLEPRGNQVSENLQQAAREASPYLTYLGAFSFQAQRDGTLVAPPLTNLRSIAENQDTTMMMIITNLENQAFSDELGRILLNDNTVKRRLLNEIVENARRYGFRAIHFDFEYLRPQDREAYNQFLREARDLFHREGLEISTALAPKTSATQQGRWYEAHDYRAHGQIVDFVVLMTYEWGYSGGPAQAVSPIGPVRDVIEYALTEMPANKIVMGQNLYGYDWTLPYTAGGNPARAISPQQAIVIADQNNADIQYDETAQAPFFRYTDAENRRHEVWFEDARSIQAKFNLIKELNLRGISYWKLGLSFPQNWLLLSDQFQVVKKTFR

SEQ ID NO: 4241 - protein, 427 aa, Bacillus sp.
MVKQGDTLSAIASQYRTTVSQITEANEIPNTDSLVVGQTIVIPIAGQFYEVKQGDTLASIARQFRTTAAELARVNRIQLNTMLQIGFRLYIPTVPKRDIESNAYLEPRGNQVSENLQQAAREASPYLTYLGAFSFQAQRDGTLAAPPLTNLRSIAENQNTSLMMIITNLENQAFSDELGQVLLNDVTVKRRLLNEIVENAKRYGFYDIHFDFEYLRPEDREAYNQFLREARDRFHREGLEISTALAPKTSATQQGRWYAAHDYRAHGQIVDFVVLMTYEWGYSGGPAQAVSPIGPVRDVIEYALTEMPANKIVMGQNLYGYDWTLPYTAGGPPARAISPQQAIVIADRNNASIQYDQTAQAPFFRYTDAENRRHEVWFEDARSIQAKFNLIKELNLRGISYWKLGLSFPQNWLLLSDQFNVVKKTFR

SEQ ID NO: 4242 - protein, 377 aa, Bacillus sp.
MKRGDTLTSIARQFNTTAAELARVNRIQLNTVLQIGFRLYIPPAPKRDIESNAYLEPRGNQVSENLQQAAREASPYLTYLGAFSFQAQRNGTLVAPPLTNLRSITESQNTTLMMIITNLENQAFSDELGRILLNDETVKRRLLNEIVENARRYGFRDIHFDFEYLRPQDREAYNQFLREARDLFHREGLEISTALAPKTSATQQGRWYEAHDYRAHGEIVDFVVLMTYEWGYSGGPPQAVSPIGPVRDVIEYALTEMPANKIVMGQNLYGYDWTLPYTAGGTPARAVSPQQAIVIADQNNASIQYDQTAQAPFFRYTDAENRRHEVWFEDARSIQAKFNLIKELNLRGISYWKLGLSFPQNWLLLSDQFNVVKKTFR

SEQ ID NO: 4243 - protein, 377 aa, Bacillus sp.
MKRGDTLTSIARQFNTTAAELARVNRIQLNTVLQIGFRLYIPPAPKRDIESNAYLEPRGNQVSENLQQAAREASPYLTYLGAFSFQAQRNGTLVAPPLTNLRSITENQNTALMMIITNLENQAFSDELGRILLNDDTVKRRLLNEIVENAKRYGFYDIHFDFEYLRPEDREAYNQFLREARDLFHREGLEISTALAPKTSATQQGRWYEAHDYRAHGQIVDFVVLMTYEWGYSGGPAQAVSPIGPVRDVIEYALTEMPANKIVMGQNLYGYDWTLPYTAGGTPARAISPQQAIVIADQNNAEIQYDQTAQAPFFRYTDAENRRHEVWFEDARSIQAKFNLIKELNLRGISYWKLGLSFPQNWLLLSDQFNVVKKTFR

SEQ ID NO: 4244 - protein, 426 aa, Bacillus sp.
MKQGDTLSAIASQYRTTVNEITETNEIPNPDKLVVGQTIVIPIAGQFYDVKQGDTLTSIARQFNTTAAELARINRIQLNAVLQIGFRLYIPPLPKSDIESNAYVEPRGTQVSENLQQAVREAVPYLTYLGAFSFQVQRDGTLEEPPMTNLKAISDSQNTTLMMIVTNLENEAFSDELGRIILNDDTVKTKLLTEIVATARKYGFRDIHFDFEYLRPEDKEAYNQFLREARDILHREGWLISTALAPKTSATQKGKWYEAHDYKAHGEIVDFVVIMTYEWGYSGGPAQAVSPIGPVRDVIEYALTEMPANKIVMGQNLYGYDWTLPYTAGGDLAKALSPQQAIVLAGQNNAAIQYDETSQAPFFRYTDSNNKQHEVWFEDARSIQAKFNLIKELNLRGISYWKLGLSFPQNWLLIADQFNIVKKTFR

SEQ ID NO: 4245 - protein, 427 aa, Bacillus sp.
MQRGDTLYRIANRYRTTVNEIVETNEIPNPNRLVVGQTIVIPIAGQFYEVRQGDTLASIAARFNIPPAELARINRILITAVLPVGILLYIPPRPKRNIESNAYIEPRGETVSPALQQAAREAVPYLTYLGAFSFQAKRDGTLEEPPLNGLKEIADRQRTTMMMIVTNLENEAFSAELGRIILRDENVKNRLLNNIVAAARRYGFKDIHFDFEYLRPEDREAYNQFLREARDRFRREGWLISTALAPKTRADQPGQWYEAHDYRAHGQIVDFVVLMTYEWGYSGGPPMAVSPIGPVRDVIEYALTEMPANKIVMGQNLYGYDWTLPYTPGGELARAISPQQAIQIASENNAAISFDETAQAPFFRYTDKAGKRHEVWFEDARSIQAKFDLIKELNLRGISYWKLGLSFPQNWLLLGDQFNIVKRTFPS

SEQ ID NO: 4246 - protein, 426 aa, Bacillus sp.
MKRGDTLSAIAARYRTAANVIAEANKLPNPNTLVVGQTLVIPIEGQYYEVKQGDTLAAIAGRFHISAAELARVNGIQPGTTLRVGTRLYIPQQANKPDIESNAYIEPRGTSVSANLQQAAREASPYLTYLGAFSFQVQRNGTLKEPPLTNLKSISDRHNTTLMMIITNLENDAFSDELGRLILNDNTVKTKLFQEIVSTAKKYGFRDIHFDFEYLRPQDREAYNRFLREARTIFHREGWKISTALAPKTSATQAGKWYEAHDYRAHGEIVDFVVIMTYEWGYSGGPAQAVSPIGPVRNVIEYALTEMPSSKIVMGQNMYGYDWTLPFKQGTTAKAVSPQQAIALAARHKVDIQYDETAQAPFFRYTDENQRRHEVWFEDARSIQAKFNLIKELHLRGISYWKLGLSFPQNWLLLGDQFHIVKETFR

SEQ ID NO: 4247 - protein, 426 aa, Bacillus sp.
MKRGDTLSAIAARYRIAANVIAEANKLPDPNTLVVGQTLVIPIEGQYYEVRQGDTLAAIAGRFHISAAELARVNGIQIGTTLQVGTRLYIPQQTNKPDIESNAYIEPRGTSVSANLQQAAREASPYLTYLGAFSFQVQRNGTLKEPPLTNLKSIADRHNTTLMMIITNLENDAFSDELGRLILNDNTVKTKLFQEIVSTAKKYGFRDIHFDFEYLRPQDREAYNRFLREARTIFHREGWKISTALAPKTSATQAGKWYEAHDYRAHGEIVDFVVIMTYEWGYSGGPAQAVSPIGPVRNVIEYALTEMPSSKIVMGQNMYGYDWTLPFKQGTTAKAVSPQQAIALAARYKVDIQYNETAQAPFFRYTAENQKQHEVWFEDARSIQAKFNLIKELHLRGISYWKLGLSFPQNWLLLGDQFHIVKETFR

SEQ ID NO: 4248 - protein, 432 aa, Bacillus sp.
MQIYVVKRGDTLYQIANRYRTTVNEIVETNEIPNPNRLVVGQTIVIPIAGEFYEVRQGDTLASIGARFNISPAELARINRIQVSAVLPVGLLLYIPPRPKRNIETNAYIEPRGESVSPALQQAAREASPYLTYLGAFSFQAKRDGTLEEPPLNNLKEIADRHRTTMMMIVTNLENEAFSDELGRIILTDQNVKNRLLDNIVAAARRYGFKDIHFDFEYLRPEDREAYNQFLRDARARFKQEGWFISTALAPKTRADQPGQWYEAHDYRAHGEIVDFVVLMTYEWGYSGGPPMAVSPIGPVRDVIEYALTEMPASKIVMGQNLYGYDWTLPYTPGGQLAKAISPQRAIEIASENNAAILYDETAQAPYFRYTDNAGKQHEVWFEDARSIQAKFDLIRELNLRGISYWKLGLSFPQNWLLIADQFNVVKETFPS

SEQ ID NO: 4249 - protein, 439 aa, Bacillus sp.
MRKEAFPIQIYVVKRGDTLYQIANRYRTTVNEIVATNEIPNPNRLVVGQTIVIPIAGEFYEVRQGDTLASIGARFNISPAELARINRIQVSAVLPVGLLLYIPPRPRRNIETNAYIEPRGESVSPALQQAAREASPYLTYLGAFSFQAKRDGTLEEPPLNNLKEIADRHRTTMMMIVTNLENEAFSDELGRIILTDQNVKNRLLDNIVAAARRYGFKDIHFDFEYLRPEDREAYNQFLRDARARFRQEGWLISTALAPKTRADQPGQWYEAHDYRAHGEIVDFVVLMTYEWGYSGGPPMAVSPIGPVRDVIEYALTEMPASKIVMGQNLYGYDWTLPYTPGGPLARAISPQRAIEIASENNAAIQYDETAQAPNFRYTDNAGKQHEVWFEDARSIQAKFDLIRELNLRGISYWKLGLSFPQNWLLIADQFNVVKETFPS

SEQ ID NO: 4250 - protein, 439 aa, Bacillus sp.
MRKEAFPIQIYVVKRGDTLYQIANRYRTTVNEIVATNEIPNPNRLVVGQTIVIPIAGEFYEVRQGDTLATIGARFNISPAELARINRIQVSAVLPVGLLLYIPPRPRRNIETNAYIEPRGESVSPALQQAAREASPYLTYLGAFSFQAKRDGTLEEPPLNNLKEIADRHRTTMMMIVTNLENEAFSDELGRIILTDQNVKNRLLDNIVAAARRYGFKDIHFDFEYLRPEDREAYNQFLRDARARFRQEGWLISTALAPKTRADQPGQWYEAHDYRAHGEIVDFVVLMTYEWGYSGGPPMAVSPIGPVRDVIEYALTEMPASKIVMGQNLYGYDWTLPYTPGGPLARAISPQRAIEIASENNAAIQYDETAQAPNFRYTDNAGKQHEVWFEDARSIQAKFDLIRELNLRGISYWKLGLSFPQNWLLIADQFNVVKETFPS

SEQ ID NO: 4251 - protein, 433 aa, Bacillus sp.
MTIQIYVVKRGDTLNEIAMRFKTTVNEIIRTNDIETPNQLVIGQTIVIPIRGQFYEVKQNDTLYQIGRRFRISVEELARVNRIRPEAILPIRFLLYIPQRPKRNINSNAYIEPRGNQVSENLKQAAREASPYLTHLGAFSFQAQRDGTLKEPPLDQLPQIAAQSRTVLSMVVTNLENEKFSDELGRILLNNQSVKTTFLNEIVRVAKKYQLKEIHFDFEYLRPADKDAYIQFLREATTRFHQEGWTISVALAPKTSSQQKGKWYEAHDYEAIGKIVDHVVLMTYEWGYSGGPAQAVSPIGPVRQVIEYALTVMPANKIVMGQNLYGYDWTLPYVQGGPIAKAVSPQQAIAIARNNNASILYDETAQAPYFRYTDATNKEHEVWFEDARSIQAKFNLIKELNLNGIAYWKLGLSFPQNWLLLSDQFNIEKRTTS

SEQ ID NO: 4252 - protein, 433 aa, Bacillus sp.
MTIQIYVVKRGDTLNDIAMRFKTTVNEIIRTNEIETPNQLVIGQTIVIPIRGQFYEVKQNDTLYQIGRRFQISVEELARVNRIRPEAILPIRFLLYIPQRPKRNINSNAYIEPRGNQVSENLKQAAREASPYLTHLDVFSFQAQRDGTLREPPLDQLPQIAAQNRTVLTMVVTNLENEKFSDELGRILLTNQSVKTAFLNEIVRVAKKYQFKEIHFDFEYLRPADKDAYIQFLREATARFHQEGWTISVALAPKTSSQQKGKWYEAHDYEAIGKIVDHVVLMTYEWGYSGGPPQAVSPIGPVRQVIEYALTVIPANKIVMGQNLYGYDWTLPFVQGGPIAKAVSPQQAIALAREHNVSILYDETAQAPHFRYTDANNKEHEVWFEDARSIQAKFNLIKELNLNGIAYWKLGLSFPQNWLLLSDQFNIEKRTTS

SEQ ID NO: 4253 - DNA, 314 bp, Artificial Sequence
  Optimized for E.coli
ccatggctagctttgactgtaaacaggcgcgtcaggctgacgaacgcgcaatttgcgcctctcgtgcgctgtcagaacaggacgttgaaatgtctgtgcgctacgaaatgctgatgggtctggttgcaatgggtacccgtggcgacatgggtgaagcgcagcagcagtggctgaaacgtcgcgctcgctgtggtgcaagccagagttgcctggcaacagcctaccgtgaacgcattgacgcactgaaacagcagtaccgtcagctgcagagccgtggtccgtttcaccaccaccaccaccactaataagaattc

SEQ ID NO: 4254 - DNA, 1667 bp, Artificial Sequence
  Optimized for E.coli
ccatggctgaatctgacggtcaggcaccgcagacagcagctgctagcagtatgcagtcatacgtggaagctatgcagccgggctggaacctgggtaacagcctggacgctgttggcgcagacgaaacagcatggggtaacccgcgtattacccaggctctgattcagcagattagtgcacagggctacaaatctattcgcattccggtgacatgggacaaacacattggtgctgcaccgaactacaccgtggaaagtgcctacatgaaccgtgttgaagaagttgtgcgctgggccctggacgcgaacctgtacgtgatgattaacgttcaccacgactcttggacatgggtgtcttcaatggaaccgaaacacgacgaagttctggcccgttacaacgcgctgtggacccagattgctcagcgctttaaagaacagccgaacaaactgatgttcgaatcaatcaacgaaccgcgttttagcgaaggtggcaccacagacgaagccaaaatgaaccagatgctgcaggaactgaacgttagttttcacaaaattgttcgtgcctctggtggcaaaaacgctacacgcccgctggttctgccgggcctggacacctcaccagctcaggcaaaaattaacgaactgtacaacaccattacaaaactgaacgacccgaacctgattgccaccgtgcactactacggttactggccgtttagcgttaacattgcgggccacaccacatttgacaaagacaccaaaaacgacattattcagacatttgacaacgtgtacaacacctttgttgcgaaaggtattccggtgattattggtgaatacggcctgctgggttttgacaaaaacaccggcgttatcgaacagggtgaaaaactgaaatttttcgaatttctgacatactacatgaaagaaaagaaaattaccggcatgctgtgggacaacggtcagcacctgaaccgtaccacatacaaatggtcagacccggaactgtttaacgtgattaaaagcagtctgaaaggccgctcttcaaacgccgcgagcgacctgattcacctgaagaaaggtacaccggctcaggacgcaaaagtgattctgaacctgaacggtaaccagctgaaaaccctgagcgttggcagtaaacagctgacccagggtacagactacgctctgagtggcgacaccctgacactgaaagcatctctgctgacatcactgaccacaagcggcaaatacggtgaaaacgctgtgattaccgcaaaatttaacaaaggtgcagactggaactttcgtgttgtggtttacgacacaccgaaactgagcgccattaaaggcaccacacaggcgttttcaattccgaccgactttcacggtagccagctggccacaatggaagcggtttacacaaacggtggcaacgctggtccacaggactggacaccgtacaaagaatttggcaacacctttgccccggcgtacgacgcgaacggtattaaactgctgccggaactgtttaacagtgtgaaagacggcgacgttaccctgaaatttcacttttggtctggtgacgtggttacctacaaaattacaaaaagtggcacccgcgttacaggtaccacatctcaccaccaccaccaccactaataagaattc

SEQ ID NO: 4255 - DNA, 791 bp, Artificial Sequence
  Optimized for E.coli
ccatggcaagtgcccagacaattaaagttaagaaaggtgacaccctgtggggcctgtctaaccgttacggtacatctatcaactcaatcaaaagcgaaaacaaactgaaatcagacatcatctacatcggtcagaccctgagcattaacggcaaaagcagttctggtagcaacagtggctctaaatcaagcagttctacatacaaagttgtgaaaggcgacagtctgtggaaaattgcgaacaaatacaaaatgacagtgaaccagctgaaaagcctgaacggtctgaaaaccgacctgattcgcattggccaggttctgaaagtgaaaggttcaaccagcggcagtgcttcaagcggtagttcttcaagcaaaaaaccgagttcttcacacaacattgcgcagacatctctgaacgttaacaaactggtgagtgacgctcagtctctgattggcaccccgtacgtttggggtggcaccacaacctcaggttttgactgtagcggctttatttggtacctgctgaacaaacagaccagtgtgggtcgtacatctaccgcaggctactggagcagtatgaaatcagtttcttcaccgagccgcggtgactttgttttctttacaacctaccaggcaggcccgtcacacatgggtgtttacatcggcaacaacaaattcatccacgccggtagcgacggcgtgacaaccagtgacctgaacaactcttactggaaaccgcgttacctgggtgcaaaacgctttcaccaccaccaccaccactaataagaattc

SEQ ID NO: 4256 - DNA, 269 bp, Artificial Sequence
  Optimized for E.coli
ccatggctggtaacgaccagagcctgagtcagtacgttaaaattaaagttcaggacggtgacaccctgtggagcctggcagaccacgttgccgagaaaaaacacatcaacaaagaagacttcatcgaatgggtgaccgaaaacaaccacctgcagacagcggacattaaaccgggtgacgaactgattctgccggttaagaaaaaacacccggcggtttaccagctggctattgtgaaccaccaccaccaccaccactaataagaattc

SEQ ID NO: 4257 - DNA, 1334 bp, Artificial Sequence
  Optimized for E.coli
ccatggctggtccggacaccagccgtcaccaggcacagattgaccagatcgttaaagacattagtccggtgcgcattgaaggttacattaacaaactggttggctttcgtacccgccacacaatgagcgacaccgtgagtgaaacagaaggtattggcgcagcccgtcgctggattaaatctgaactggaacgttgtggtgctgctcagggtggccgcctgcaggttgcctttgactcacacattgccccggtgtctgcgcgtatttcacgcccgacagaaattgttaacgttgttgctacactgccgggtacacaggcagccagcgtggaccgtatgtacgttgtgagcggccactacgacagtcgcaacaccgacgttatggacgcaaaaggtgacgcaccaggtgctaacgacgacgctagtggtacagcggctgttatggaaatggcttgcgtgatggcaaaatacaaatttgacgctaccctggtttttatgacagtggcagccgaagaacagggtctgctgggtgctgctcactgggctgaactggcacgtcagaaaaacctgaacattgccggcatgtttaccaacgacattattggtagcagtcgtgacgaacacggcaaagttgacaacacacaggtgcgcctgtttgctgaaggcctgccggttcagaaagaaaacagcgacgcagtgcgtaccctgattcagacaggtggcgaaaacgacagcctgagtcgtcagctggcacgtgcggttaaagaagcgggtgaacgctacgtgccgaaatttaaagttaacgtgattcagcgtcgcgaccgttacctgcgcggtggcgaccacatgccgtttctggaacgtggctacgcagccctgcgctttaccgaaccggcagaagactttaaccaccagcaccagaacattcgcacagaaaacggtgttctgattggcgacctgccgcagtacgacgactttaactacattgcccaggttgcgcgtgtgaacgcggctgcactgtcttctctgtctctggcaccagctgctccagctaaagttcaggtgcgcaccgctaaactgcagaacgacacagaactggtttggcaggctaacgcagaaccggacctggcaggttaccgtattgtgtggcgcgacacctctgctgcagaatggcagggttcacagtttgttggcaaagccaccgaatttacagtgccgctgtcaaaagacaactactactttggtgtgcaggcgattgacaccgaaggcaacgcttctccggcatcatacccgacaccgctgcgtcaccaccaccaccaccactaataagaattc

SEQ ID NO: 4258 - DNA, 1130 bp, Artificial Sequence
  Optimized for E.coli
ccatggctagcgttaaaggttactaccacacccagggcaacaaaattgtggacgaaagtggtaaagaagcagcctttaacggtctgaactggtttggcctggaaaccccgaactacacactgcacggtctgtggagccgttcaatggacgacatgctggaccagatgaagaaagaaggttacaacctgattcgtctgccgtacagcaaccagctgtttgacagcagttctcgcccggacagtattgactaccacaaaaacccggacctggttggcctgacaccgatccagatcatggacaaactgatcgaaaaagcgggtcagcgcggcattcagattattctggaccgccaccgtccatcaagcggtggccagagcgaactgtggtacaccagtcagtacccggaaagccgttggattagtgactggaaaatgctggctgaccgctacaaaagcaacccgacagtgattggtgcagacctgcacaacgaaccgcacggccaggcatcttggggtacaggcaacgcgtcaacggactggcgtctggctgctcagcgtgctggtaacgcaattctgtctgttaacccgaactggctgattctggttgaaggtgtggaccacaacgtgcagggcaacaactcacagtactggtggggtggcaacctgaccggcgttgccaactacccggttgtgctggacgtgccgaaccgtgttgtgtacagtccgcacgactacggtccgggcgttagttctcagccgtggtttaacgacccggcttttccgtctaacctgccggcaatttgggaccagacatggggttacatttcaaaacagaacattgcgccggttctggtgggcgaatttggtggccgcaacgttgacctgtcaagcagtgagggtaaatggcagaacgccctggtggactacattggcgcgaacaacctgtactttacctactggagcctgaacccgaactcaggtgacacaggtggcctgctgctggacgactggaccacatggaaccgtccgaaacaggacatgctgagccgcattatgaaaccggttgtgtttgtggccgaacaggcaaaagccaccgcggaacaccaccaccaccaccactaataagaattc

SEQ ID NO: 4259 - DNA, 1463 bp, Artificial Sequence
  Optimized for E.coli
ccatggcagccagcagtgtgggtaccgttaaaggcgacaacgttaacgtgtaccgtagtccgtctctgcactcttcaattgtgcagacagttaagaaaggtgaagaatttccggtgattagcagtgaagctggcgacgcggctcaggttaccacacacaccgttgtgccgggtaacacactgtggctgctggcaaaacagtacggcgttaccgtgagtgacctgattaaacagaaccagctgaagaaaaccgaactgattccgggtcagacactgaaaattccggccaaaggtctgctgcacaaagttgtgtcaggcgacacactgtggaaaattagcgtgaaatacggtgttaaagcgaacgaactgaccaaactgaaccagctgtcttcaacaaacattaaaccgggccagatgctgattattccggactactacgttcaggtgcagctgctggaaggtaagaaaggttggattaaaaaatctgacctggcacagaaaaaacaccagccggttgtgatgggttggtcatttaacgaaaaagcagccggctacaccgaaagcatgaaacagaaaaacctggacgttgtgagtccgcgttggtttaccctgacatctaacgacaaagttgtgagcagttctattaacgaatcatacgtgcagaccgctcacaaaaacggtaagaaagtttggccgctgattggcaacaactttgacgacgtgctgacatcagacgttctgagcaacaaagcaaaacgccagaaactggtgtcaagcgttgaaagttctctggtgaaaaccaaaagcgacggtattaacgttgacttcgaaaacatcaacatcaaaaacaaacaggactttgtgctgtttattaaagaactgaaagcggctctgaaaagtcacggcatgaccgtttctgtggacgttacacgtgaaaacaacgacccgttttggtcaggtagctttgaccgcaaacagattggccaggtggccgactacgttattatgatgggttacgaagaacactggggtggcagtcaggtgccgggtagtgttgcctctctgccgtgggttaaagaaggcacccagctgctgatgaaagacgtgccggcgcacaaaattctgctgggcgttccgttttacacacgcgaatggaaaaccgacctgtctaccaagaaagttgtgaccaaagacctgacaatgaaagaagctgaagcagtgatctcaagcaaaaaactgaccaaaaaatgggactcacagacaagccagtactacgttgaatacaccgaaaacggtacaaaacaccagatttggctggaagacaaagcgagcatgcagcgtcgcgtgaacctgattaaagactaccacctgggtggcgcagctgcttggtacattggcagtgaaacctctgacatttgggaactgtacaactttcaccaccaccaccaccactaataagaattc

SEQ ID NO: 4260 - DNA, 953 bp, Artificial Sequence
  Optimized for E.coli
ccatggaacaggcggaagctagcgttaactacgaccacattgtgccggcagccaaacagtacattggtgttccgtaccgctggggtggcaccacagccaaaggttttgactgttctggctttattcgtcacgtgtaccagtcaattggcattgacaccccgcgcaccgctacagacatgtaccgtatgggtaaacgcgttgacaaatctgcactgcgcgttggcgacctggttttctttaacacatctggtaaaggcgtgtcacacgcaggtatttacattggcaacaaccgttttattcacagcagttcttcaaaaggtgttaccattagcagtctgaacgactcatactggaagaaaacctacattggtgccaaacgtgttctggcttaccgcctggcaccgggccagtttcaggacgtgtctccgtcacactgggcgtttgacgaagttcgcaccctgagcgaacaggaactggtgattggctacgaagacagttactttaaaccggacgaaccgattacacgtgctgaagttgcggcttacctggcagaatacctggacctgaacctgagcgaccgcagtgttccgtttaacgacgtgccggacgactactgggcactgggtgccattcgtgcggtgcagaaacagggcattatgaacggtagcaacggcaaatttcacccggaagacaccctgacacgtgctcagctggcagctgttctgacacgcgcttttcgtctgcagccgccggctgctgcaaaaagctttacagacgtgccgccgagtttttgggcctttcgtgacattcaggctctggctgctgctggtattgctacaggtcgtacagacggtagttttggcccgaacgaaccggttacccgtgtgcagtttgcagcctttctgtaccgcgcgatgcaccagcaccaccaccaccaccactaataagaattc

SEQ ID NO: 4261 - DNA, 4790 bp, Artificial Sequence
  Optimized for E.coli
ccatggaaaacgctcgtgctcacggtaaagctacacgtgctggtaaactgccagcagcactgggcagtacactgattctgctgtctggtgctatgctgattgctccgacagtgcacgctgctaacgcagcagacgcaacagttaccctgggcagtggttctgtgtcaacagttggcaacactacaaccattaaacagaactcacagaacctggctattgactgggttggtctgagcaccgcggctaacgaagcactgatttttaaccagccgaacagcagtgcaattgccctgaaccgtattaccggctcttcaccgagtacactgctgggttctctgaccgccaacggccaggtgtttattctgaacccgaacggtgttctgtttggcgctggtagccaggttaacgtgggtggcctggtggcatcaaccctgggtatgagcaacgctgacctgcaggctggtcgtatggtttttgccctggacggtaacacaaacggcagtgttgtgaaccagggtaaaattaacgcagccgacggtggctacattgcgctgattgcggctaccgtgcgcaacgaaggtgaaattaacgcaaaactgggtacagctctgctggcagctggtaacaaagttacactgaacattaacaacggtagtctgctggcttactctattgaccagggcgcactgaacgcgctggctgaaaacaaacagctgattcaggccaacggtggccaggtgctgatgtctgcaaaagccctgaacaccctgacaaccgccgttgtgaacaacaccggtctgattgaagcgaaaacaattgaaaaccgtaacggccgcattatgctgatgggtgacatggaagtgggcacagttaacgttgctggtaccctggacgctagtgctccaacctctggcaacggtggctttattgaaacatctgcggctcacgttaaaattgcagacgacgccctgattacaacccgtgcgaactcaggtaccagcggcagttggctgattgacccggttgactttacagtggcagccagtggtggcgacattaccggtaaagccctgtctacccagctggcgaacaacggcctggttaccattatgaacacacagggtgctagcggcaccgcaggtgacattaacgttaacgacacagtgtcatggagcagtaacagcgtgctggaactgattgcgcagcgcgacattaactttaacgcggctgttacagctaccggtacaaccgcaggcctgaaactgacctacgccggtgactacaaagtgaaagcgccgattaccctgtctggctcaaacagcacactgaacattaacggtaacaactacaccctgattcgtagtatgtctcagctggacctgctggacggttcaaacagcgttacaaacaccggcacagcgcgccagctgaacggttactacgcactggcacaggacctggacgcagcaggtacaacctacaccaaatctctgctgggttcttcaagcagtacaacctttctgggcacatttgcaggcatgggtcacaccatttcaaacctgacaattaacgcggcaggtggtgcaggcctgtttggtctgattggcgcgggtagtgttgtgcgtgacctgggtatggtgggtggctctatttacggcgctaacggtgacgttggcgcgattgctggtcgtaacagcggtggcaccattaacaacgtgtacgcaacaggcatgatggttggtggcacaacccgcattggtggcattctgggttacctgaacggtggcaccctgagtaactcttactcaaacgtgacagttgtgggtggcaactcttcaagcggtggcctggttggtaccaacagcggcagtatttctaactcatacgcagaaggtgaaatttcaggtggcggtctggttggcggtctggtgggtaccaacaacgcaggcgccagcattacacagtcatacgccagcggtaacgtgattggcaactttggcggtagtcgcgcgggcggtctggttggtctgaactcaggcgccattagctacgcgtacgcttctggtgcggtgagtggcgactctctggttggcggtctggtggcctggaactacccgggcggtagcattagtaacgcatacgcctctggtaacgttaccctggttgtgaacccggctctgtcaggcacatacgcaggcggtctgattggtagcgacagttctacaaccacaaacgcggtgtgggactcaagcagttctggtcacgttagttacaccggtacaattggctctgctaccaacaccacagacgtgaacgcaggtaaccgttaccagcactcagcgtacagcgctctgggcagttggcaggaaaccgccacaggctctggtgtttggattgcgtacgacggttcaaacaacccgcagtgggttatggtggaaggcagcacccgcccgtttctgtacagtgaatggtctaccacagttggtaacgctcaccagctgcagctgatggcagccaacctgagtgccaactacaccctggcgaaaaacattgacctgtctgcggctcacggttcaaacgcaagcggcatgtggaacgccaccggttttgcgagtattggcaactctctggcagccttttctggtacactggacggcaaaaactacaaaatctcaaacctgcagatcatcaaaccgaccagcgacaacgtgggtctgtttggcgtgacagctgttggctcaaaagtgcagaacgttggtctggtgtctgcatcagttagcggtcagacccaagttggcggtctggtgggttacaaccgtggcgaactgagtaacgtttctgtgcagggtcagatttcaggcggtattagcgttggcggtctggcgggtctgaacatgggcaccattaacgctagttacggtaacgcagttgtgtcaagccagtctggctttgttggcggtctggtgggtagtaactctggccgtatttcaaacagctacgctgacggtaacgtgtctgctgaccgtgacgttggcggtctggtgggcgcaaacgaagccaccggtattattgaaggcagctacgcggctggtcaggttaacgtgtaccaggcaggcggtggcctggttggttctaaccgcggcaccattagtaactcttacgcgatggcttcagttagcggtgtggcaattgccggtggcctggttggtgtgaacgacggtactatcagtaactcttacgctaacggtgctgttctggtgggcgttgccggtggcggttttattggtatgaacaacggcgcggtgaacagttctttttggaacagtgacaccaactctacaggcgttggtgccggcgtgaacaccggtgttacaggcattaaccacgcgcaggctcagctggcttcaacctttgttagcgcaggttgggacatgggcaccacaggcggtaccagcacaatttggcgtatttacgacggtctgtcaggtccgctgctgcgtagctttctgaccccggtgacagttagtgcaaccgtgaactctaaaacctacgacggtagcggcacaatggctaacggttacaccccggttgcaggtgtgacactgtcaggcagcctggtttttacctcaagcaaaaacgccggcagttacagttcttcagacggtaccctgcagcagggcggtctgagcagtacacagcagggttacgacatttcatacgcagacgccagcctgaccattaacaaagctaacctgaccgtgacagcaggcagtgcttcaaaaacatacgacggtaccacaaccgcaagtggtaccattaacgtgggtacactggctggtgctggcgacctggttaactcaggcggtagcctggcctttgacgacaaaaacgcgggttcaggcaaaaccgtgattgcaagcggtgttacaattaaagacgcagccaacggcgacgtgaccgacaactacaacatttcttacgttaacaacacatcaggcagcattgcaaaagccaacgttaccctgaacgttacagacgtgaccaaaacatacgacggtacaaacaacgctgctgcagcactggctgtgcagtctggtcagctgtacggcctggacgaagttacagcgggtagtttttcttttaacaacaaagacgctggtaacaacaaaaccgtgtcagcaagcggcgtgacagttaacgacggtaacaacggcaacaactacaacgttaccgttgtggactcttcaaacagtacaattaaccgtgcggctctgaccgtgacagcgaacgacgctaacaaagtttttaacaacctggcctacgtgggcggtaacggtgttaccctgaacggtctggtgcacggcgaaacaattgctgacctgcagggtgctctggcttacggcggtacagcacagggtgcaacaggtgctggtaactacattattagcgctaacggtctgagcagttctaactacgcagttacctttgtggacggcacactggttattcgcccggcagtgagtgttccgaccggtgttgtgccaggtgaactgctgccagcttaccagacagcaattcgtaacagtgactctgacctgcgccagaacaacgacggtaaagacgaagacctgaaagtggcagcctttcagccgccgattgagaaaaacgacgctgctgacgcagcccgtccgaccccgcgcctgacaatttcatcttgcggcctgcagctgccagcagacgctggtaacagcgtttgccagcaccaccaccaccaccactaataagaattc

SEQ ID NO: 4262 - DNA, 731 bp, Artificial Sequence
  Optimized for E.coli
ccatggccaacattgcgccggttaaagccaacaacgttgttctggtgcacggtagctgggctgacggtagcagttggagtgaagtgattacacgtctgcaggcagccggtctgcacgttaccgctgtgcagaacccgctgaccagcgttgcaaacgacgtggcggctacccagcgcgttctggaccagcaggacggtccgaccgttctggtgggtcactcttacgccggcacagttgtgtcagaagcgggcgttgacccgaaagtgtcttcactggtttacgtggcagcacgtgctccagacgcaggtgaagactttgttgctctgtcaggcaaatacccaaccatgccagtgcgtgctggtacagaagaacacgacggctacgtttctctgaaacaggacgcctttctgaaatactttgcgtcagacgtgccgcacgacaaagcaatggaactgtttgcggttcagcagccgattgcaaaaaccctgtttggcgaacgtaccacagcggctgcatggcacacaaaaccgagctggtacgcagtgagcagtctggaccagaccattaacccggacctggaacgttttctggctaaacgcatgggtgcaaccacaattgaactgccgtcttcacacctgagcctggttagccacagtaaagaaattgctgacctgattctggaagcaagtggccgccagccgcaccaccaccaccaccactaataagaattc

SEQ ID NO: 4263 - DNA, 959 bp, Artificial Sequence
  Optimized for E.coli
ccatgggctctaccaaacaggaccagctggttacagaagctaaaaaacacattggtgtgccgtaccgttggggtggcaccacaacctctggctttgactgttcaggttacatgcagtacgtttttaaccagattggcattaacctgccgcgcacaaccagccagatgtacaacaccggcacatcagttagcaaaagtaacctgcaggttggtgacctggttttctttaacacctctggttcaggcgtgagtcacgctggtatcttcatcggcaacaaccagttcatccactctgcaagcagtcgtggtgtgtcaatttcttcaattaacgacccgcactactggggcagccgttacattggtgccaaacgcgttatgaccaacacaccggtgcgttctctgggttcaggcgaattttacgacgttgccaccaaccactgggcgtttagcgaaattcgccagctgagtaacaacggcattattggtggcgtgggtaacagtaactttgctccgaccgaccagctgacacgtgcacagattgcagccctggttgtgcgcgccaccaacacaccgctgacaaccacagcgaacggttttaacgacgttagccagagtcactgggcggctgcagacatttctgccgcggaccgtgccggtttctttgaccacattcagggtgacagctttaacccgaacgcgaacgttagtcgcgccgaaattgcggtgatttttagcaaagcttttgacctgcaggcaaacggcagcagtgctagcgcatttagtgacattaactcttcaaactgggcctacaacgaaattaacgcgctgcactctaacggtctggtgcagggctttaccgacggtacataccgtccgagcagttctatttcacgcgctgaatttgcaaaaattctgcacggtgcactgtaccaccaccaccaccaccactaataagaattc

SEQ ID NO: 4264 - DNA, 773 bp, Artificial Sequence
  Optimized for E.coli
ccatgggcagcagtacagttgtgcgtgaaccaagccgcggtggcggtcgtccgtctgcgtcacgcccgtctggcagtcgtccggcaccgccgccggcaagtcgcccgaaatacggtgctaccgtgacagttcagcgcggcgaaggtctgtaccgtattgcgacaaacaacggcattcagctggctgacctggcagcctggaacaacctgagcccgccgtacaacctgtacccgggtcagcgcctgcgcctgtacccgcagagtggcggtcgcccgtcttcaggctctgtgtcagccggtagcagtgttgcgggcggtaccacagctccgcgtccgtctaccccgccgccggctccaacagcaagcgtggacagtggtattcgttggcgctggccatctgacggtccactgctgggtcgctacctggcaaacgaaccgaccaaacagggcattgacattggcggtgcctctggtgctccagttcgtgctgctgcagacggtgttgtggtttactcaggcacaggtctggtgggctacggtgaactgattattgttaaacacaacgaacagtggctgagcgcctacggtcacaaccgtaaacgcctggtgaacgaaggccagctggttaaagcaggtgaccagattgctgaaatgggccgctctggtgctgctcgtgacatgctgcactttgaagtgcgttacaacgcaaaaccggttgacccgatgctgtacctgccggccaaacaccaccaccaccaccactaataagaattc

SEQ ID NO: 4265 - DNA, 500 bp, Artificial Sequence
  Optimized for E.coli
ccatgggctctattgaagttggttcaaaactgcagggcaaagtgaccggtattacaaactttggcgcgtttgttgaactgccgggtggctctaccggtctggtgcacatttcagaagttgctgacaactacgtgaaagacattaacgaccacctgaaagttggcgacgaagttgaagtgaaagttattaacgtggaaaaagacggcaaaattggtctgagtattaagaaagcagtggacaaaccagaacgtccggaacgcccggaacgtccggcacgtgccccgcgtagcgaccgtccgcgcgacagtcgcccgcagcgtaacaacaaccgcggtggcggtaacgactttcgtaccaaagaaacattcgaacagaaaatgaaccgctttctgaaagacagcgaagaacgcctgagcagtctgaaacgtcacacagaaagcaaacgcggcggtcgtggcgcgaaacgtggtcaccaccaccaccaccactaataagaattc

SEQ ID NO: 4266 - DNA, 914 bp, Artificial Sequence
  Optimized for E.coli
ccatggccgaaaacgaacgtgcagccccgacagttgaaagcagttctgcaccgggttcaccgagcgaagcggctaccacagccacaagtgcagccgaaaccggtggctctcaggcgcgtgaaagtggcgaatctgcggctgacgaacagcgcacagccgttgctgtggcagctgctccagcaattccagctcgtacagcttcaggtgtggactctggccgtccgcgtaaaccagttctggctgtggcaggtattgttggcgctgcactgattgcggtgccgctgctgctggcaggtggtgttgacgaagacaaacgcccggaaggtccgaaagaactggccgcgggcgaatcagacacagtgctggacccaggttctgcaggtgctgcactggacgactacgttgccgaaaaaccgaccccgacaccgaccgtggaaaaaccggaaccgtcagcaccggttaaagctgtggcaccgccgccggcaccaaaaccagaaccgaccacaagcgctccggcaaagaaagttatgccgaaaccgaaagctaaaccgacaccgaaaccggactggacagcaagtaccgttcgcgccgtgagtaccctggaagtttctcaggcgtggaccacaaaccgtattcgcatggtgatgcagccggacggtaacctggttgtgtacaacgagaaaaacaaaccgacatgggcgagtatgacctttggcgaaaaccaccgtgctatttttcagtctgacggtaacctggttattcacaacggtgacgaccgtccaatttgggctagcgacacatggggtaacgaaggcgctgaactgattctgcgtgaagacggtaaagttgtgattgcacgctcaggcaaagtgctgtggagcacccaccaccaccaccaccactaataagaattc

SEQ ID NO: 4267 - DNA, 323 bp, Artificial Sequence
  Optimized for E.coli
ccatggctaccgacgcagccgcggctgcaccgattaaccgtacaaactgtaaccagaacgactacctggaaattcacaacaacaacggtcgcgacaccctgtgctttgccaacgcgggcgaaatgccggttgcaatttacggtgttaactgggtggaaagcggcaacaacagtgtgacatttcagtttcagcgtaacgaatctgacccgcgcattgaaaccgttacactgggtaaatggagccagtggaacccgggtcagccatacctgcacaaaattctgtggattaaaattcaccaccaccaccaccactaataagaattc

SEQ ID NO: 4268 - DNA, 5072 bp, Artificial Sequence
  Optimized for E.coli
ccatgggtccggaaccgattctgcgtccggttatgccggtggcacgcgacctgcacctggacctgctgaaagctcgcgtgccaggttggtacagtgcagcaattgttcagcgccagcgtgaactgtctgaccacacactggaactgccggactggtacgccaaagcgccgtacgaaacccgcgcgagtctgaaaagcagtcactctcgctaccgtgaaattctgaaccaggttgacaacgtgctgggtgacattcaggacattcgtgcttttgcagaaccgctgctggaacaggcgattaaagctgaatttaaacagaccctggacgttaaccaggtgtactttgttcgcaaatacggtcgtcaagtgcgtggtgactttttcggtgccctggttctggacaaaggcgacagtcagtttaaccagtacgaataccacggttcttcactgctggaagcggctctggccaactttgaaccggacgaagaaaaccgcccgggttgtgcggactgcacactgattaccacacagcgtccgttttacggtggcgaagtgatgccatctaccagtgcttttcgtgctggtgctctgccaattgcaccgcaggcttttgcacgtctgtgtcgcaccctggacctgggtcgtctgtaccaggaacacattaacgccattgttcgtccgccgaacgaagcgtctcgtaaccagctggaccgccagctgcgcgaccaccaccgtcagggcctggcactgtcaatggaaattgcccgcgcgaaaggtgacattagccaggcagcctttcgtatgctgcagcaggttgtgggtgaccaggacgccattacactggacgaccgtgcggttacatttaccagtctgaaagtttttgacattgaactggtgggcccgctgctgattggtccggaacgtgaaaactctcgtcgcgtggaacgcctggttgcgtacctgccgggtgacccggaacagccactgaaagaatttgcaagcagtgccgactttatggctcagacccgtcgccgtctgcgcggtattggctaccgtcgtttctttagccgttttgttccgctgcgcaaacagggtgttttctttgaacagtttaaccgtctgtaccagccgagtgaacaggaaaactctctggtggactacccgctgaaaagcaacctgcgccgtctgccgatggacacatcaccgattccagcaccgctgtgggaaagcctgcgtctgcgtcaggttcagaaaattcagctggacgctcgtgcagttgctgtgccaaccggtgacgaagacaagaaagcacgtctggctcgccaggaatcatacctgaacgccgtgattgacgttctgaacctgggtgcttttgttgtgccaggtctgggtccgctgatgctgacagtgggtgccgttcagatgtttaacgaagcgtttgaaggcattgaagcttttgaacgcggtgaaacccgtgaaatgtgggcacacttttcttcagtggccctgaacacagcatttgtggcaacaggtgctgctgtgctgccacacattcagtggagcaacaccgttgaacagctggaaccgctgcgcctgaacaacggtgaagcacgcctgtggcgcccggacctggcaccataccgttcagacctggttccgtctgctggtgctgtgccagacgctcgcggcctgcaccgtgtgaacggtcgcccgattctggcactggacggtcgtcactacgaagttcagctggaaccggccacacagcgctaccgtattcgccacccatcacgcccggaagcataccagccgaaactgacagacaacggttctggtgcttggcgtcacgaactggaacacccgcacggttgggcaggtgcaaaactgatgaaacgtctgggtcaccgcgtggaacactttagtacagccgaactggaacagattcgcattgcgtctggtaccggcgaagacgttctgcgccgtatgcacattgaaggtgctccaatgccggctctgctggctgacaccacaacccgttttgacatttgccgccagattgaaacactgaccgcacagctgcagagtgaagaagcgctggactacgacaaagctgaaccgatgacacagctgcacctgctgacacgctacggtccgtggccaaaaggtctgcagctggaagttgtggaccgttctggtcgccgtctgtggcactacgcaccagacccgcaggctggtgcagcagcgcgtggtgtgtcactggcggaagctaacgtgcgcacaccgagcgttctgaaaaacctgattgaagcagttgacgctgcaggtggcgacctgctggcagacgcatcaccagctattgctaaaacagacatgccagctcgtgtgcgtcagctgcgtaaacagctggcagaaattgttgtgcgcgaaaaagttagcctgtttaacgactactacgccaaacaggacctgagcagtgacccgcgtgcgaccctgattaaatctcgttttccgagcgtgccagctgctgctattgaccagatgctggcactggccacaagcgccgaaacccagcagatggacgcgtgggactttgctgacgcagcccagacaaaaccgattccgctgcgtattgcggaagaactgcgccactttcagcgtaccgttcgcatgaaccgtgcttacgaaggtctgtaccaggaaccgctggctacagctgacaccccgcgtctggcactggccacactggaaaccctgagcggctggagtgacacagtgcgtattgaactgcgcgcagacgacctgaccggtgacctgattggtgcaattggcccgcagggtgcccagcagaccaaatacgttattaaagacggtggcgcctacaaaagtctggacgaccagggcaacgacctgagtcactggggttctctgtacgacgcactgcagcgtgcactgccggacgctgaacgtcaggctatgggccgcccgtctattcaccagggtgacctgctgaaacaggcgattggtgcggctccggcttctcgcgactcactggcaagcctgctgaaactgccgccggtgatgccgagttacaaatctccgatgcgtctggcgtcaggccaggttggttacccgctgggtggcctgcgtgaacgtctgggtctgtctcgttcaccgcagagccgcgtgctggaactgtacccggactacacagaacaggaagttcaggcactgctggaagcctttggtgacggcgcagttggcgaactgaaacgccgtaaagtggaactgcagatgctggaccgcgacctggacctgtgggcaaacaccccgggttggcgtgaagttggtcgtcagcgtcaccagctggttgaaccgcaggcacgccgtgctgttgctgaacgtattaaacgttgttggcgccgtcaggttccggttgtgacagcagtggacggcagtcgtgttggttacgaactggtgctgtctcagcagtacgtgggtgaactgccggacctgaccgccaacttttcacacgttgcgagcctgaaactgaacgacatgggcctgacacgcgaaggtagcgaaagttttctgaccggcttttcttcactgcgttggctggacatgacactgaaccgtctgacagacgtgccagcagcactgggcgccatgaacggtctgacacgtctgcagctgggctcaaaccagattcgtctgacctctcgctcagttggtacactgcaggacctgacccagctgaaaattctgaacctggaaaacaacccgctggaccgcctgccggactttagccactttccggcgctgcgtggtctgtacctgaaaagtacagacatttctgtgtggccacgtggtctgggtgaactgccgctggaacgtgtggacctgcgcgacaaccgtctgaccgaagttccagacgacctgattgacccgccgccggcacgtgcactgattacagcacgcctgaacggcgttaccctgctgcagggtaacccgctgtctgaactgacacagcagcgcctgggtgaatactgggctaacatttcactgacccacccgcagtggatggcactgcgtagcccgggtgcttttggtcacgctctgccaggccgtccgagtaacgtgcagcagtggctgcgcaacctgccgtctaacgaactggaagctcgtaaagacctgtggcgtagtctggcacgcgaaccgcagtctaaagaactgtttcgtctgctgaaccgcctggcgggcagttaccagggtgaagaaaactacccggacctgcaggctcgtgtttggcagatgctggaagctgctcgtgactctacccagctgcgccgtgaactgtttgaactggctggtgctccagcatgtgaagaccgtgcagccctgagctttagttacctggaaattcgtctgatgattcacaacgcacgtgctctggcaggtggtacagacgaagcggctgttctggtgcgcctggcgaaaggcctgtttcgtctggacgaagtggaacgcattgctctgcaggacattcagcagcgccgtgacgcaattaacgcacgccgtgacctgacagcagcacagaaagcacagcacctgcagcagattgaagaagttgaagtgcgtctggcctaccgcgttggcctgaaaggtcgcctggaactgccaaaacagccagccggtggccgttttctgatgctggctggtgtgacccaggaagcactggacgcggctgcagaacaggttctggcgctggacgactcaccggaacagtttcagagcctggtgggccgtgacttttggattgactacctgaaagaacaccacccgacaagttttcaggctctgacagacaccctgattgcaaaccagattgaactggacgaagctaaagccgcgggtaccctggaagctgcagactacgcatctcagtcagaagcactggccctgcagtttaaagttaaagaagcagaactgattcagtcactgacacagagcgaactggacgccctgccggaatctaccgaactgcaccaccaccaccaccactaataagaattc

SEQ ID NO: 4269 - DNA, 1505 bp, Artificial Sequence
  Optimized for E.coli
ccatgggcgctgacgcagccccggaatctgcagtttttcagcacaagggtaaagcgcgttttgctagcaaatttgttagtaacccgaacattgccggcagcctgaacgacgtgctgaaaggtagtaacccggaagttaagaaagcagttagccagaacattctgagtggctttgcggctgacgttctgctgaaaaactgggacgttgtgggtctggaatttgacaacattctggtgaccaaagacaagaaagcaattcgcattgacaacggctctgcgtttctgtcacgtgctatgggtgaacgcaaatcaccggcaagcctgagtgaactggacgaaattcagggcctgtttaaaccgagcgttaacgcaagttacgccaaaattgcagcccacgcgggttgtgctagcattcaggacattccgaactttccgcagcaggttaaaagtattgtggacctgcgtaactctggtggcacagactcatggcgcccgctggtgacagcatggacaccgggtatggcacgtcgcgaccaggacgctattattaacatgctggacgttcgtacagaaaaactgaaacagctggttgcatctccgtcaacccagtctacaggtatttcagctaaagacatgaagaaagcaagcggcgacctggacgacggtatcaaactgaaaaccgttatcgacgaatacctgggcccgaaaccgaagaaagaagacatgcagaaaattatgcaggtttacaacggtatggtgcagaaaattattcagcacccggaagttgcgaacagtgacgtgtttaaactgatttggaacaacccgaacctgctgaaagaaggcgactttgaagaaattaacccgcacgacaccaacccgcacgacattaactctctgtttaaagttacagacaacctgaaagaaagcagtgacggcgaatttgacaactgcaacaaaggtgaaatggtgtcaacactgctgtacaccacaggtctgtctaacaaaattaacaccgcactgtcaaaaaacgacgttccgacactgaacaaactgtctccgattctgaacggcgtgtcttcaatgattggtaaaggcccgggttactcaggtaaaacctaccgtgttaaagaacacgacggcgccgtgctgcagggtttttacaacgcctacaaaaacaacacagcgattaacgtgccgtgttttctgagcaccacaaaagacaaaggcctggcgcgtcgctgggagaaaaacaaaccgaacgaaagtgactttaccggtaacacatgctttcacattaccgttccggcacaggtgcacgccaacggcaacaaagctcgcgacattacaaaactgggtgaagaagaagaagaacaggaagttctgtttaaccaccacaccaacttcgttgtgacagacttcaaaaacatcggcgacaacaaaatcggtaacaaatacctgatcagcctgaccgcagtgcaccaccaccaccaccactaataagaattc

SEQ ID NO: 4270 - DNA, 1313 bp, Artificial Sequence
  Optimized for E.coli
ccatggttaaacagggtgacacactgagcgcaattgccagtcagtaccgtaccacagtgtctgaaattaccgaaacaaacgaaattccgaacccggactcactggttgtgggccagaccattgttattccgattgcaggccagttttacgacgtgaaacgtggcgacaccctgacaagcattgcgcgccagtttaacaccacagcagccgaactggctcgtgttaaccgcattcagctgaacacagtgctgcagattggttttcgtctgtacattccgccggcaccgaaacgcgacattgaaagcaacgcctacctggaaccgcgtggcaaccaggttagtgaaaacctgcagcaggctgctcgtgaagcttctccgtacctgacatacctgggtgcgttttcatttcaggctcagcgcaacggtaccctggtggctccgccgctgacaaacctgcgctctattaccgaatcacagaacaccacactgatgatgattattacaaacctggaaaaccaggcatttagcgacgaactgggtcgtattctgctgaacgacgaaaccgttaaacgtcgcctgctgaacgaaattgtggaaaacgccaaacgttacggctttcgcgacattcactttgactttgaatacctgcgtccgcaggaccgcgaagcgtacaaccagtttctgcgtgaagctcgcgacctgtttcaccgcgaaggtctggaaatttctaccgcgctggctccgaaaacctcagcgacacagcagggtcgttggtacgaagcacacgactaccgcgcccacggccagattgttgactttgttgtgctgatgacatacgaatggggttacagcggtggcccgccgcaggctgtgagtccaattggtccggttcgtgacgtgattgaatacgcactgaccgaaatgccggccaacaaaattgttatgggtcagaacctgtacggctacgactggacactgccatacacagccggtggcaccccggcacgtgccgttagcccgcagcaggcaattgtgattgccgaccagaacaacgcaagtattcagtacgaccagacagcgcaggctccgtttttccgctacaccgacgccgaaaaccgtcgccacgaagtgtggtttgaagacgcgcgttctatccaggctaaattcaacctgatcaaagaactgaacctgcgcggtattagctactggaaactgggcctgagttttccgcagaactggctgctgctgtcagaccagtttaacgttgttaagaaaacctttcgccaccaccaccaccaccactaataagaattc

SEQ ID NO: 4271 - DNA, 290 bp, Artificial Sequence
  Optimized for E.coli
ccatgggtattgaccacgttacctgtaacccgggtgcaggctacctgaaaatttggagccacctgaacggtcgtgacagtgtggactgctacgccaaccgcggcaaaaccaactttggtggttggtgggttgacaaaatttctaccggtaacaacgacgtgaaatactacgacgcgaacggcgacgttgtgaaaatcaaccgtcacaaagttatcagcttcccgaaccgtccgccgaaagtgaaagcaattgaaattctgcaccaccaccaccaccactaataagaattc

SEQ ID NO: 4272 - DNA, 314 bp, Artificial Sequence
  Optimized for E.coli
ccatgggtgacaacgacccgcagaaaaagaaagcagccgacgcagacagcagtcagccggttagcgacacctggattaccacaaaagtgaaatcttcactgctggcagacagcgacgttagtggtaccaaaattgaagttgacacagtggacggcgttgtgtacctgacaggtacagttggcagccaggctcaggctgacgaagctaaacgtattgctggtgaaattgacggcgttgccaaagtggacacatctcgtctgaaagttgacgcacaggcctcacgccaccaccaccaccaccactaataagaattc

SEQ ID NO: 4273 - DNA, 971 bp, Artificial Sequence
  Optimized for E.coli
ccatgggtagcaagaaagacaaatcacagtacccgccgccgggtgaactggttgacgcaggtggttaccgtctgcacattcgcaaactgggtaacggcagcccgaccattctgctggaatctggttcaggcgaaagcagtctgagttggcgtgacattccggaaaaactgtcttcatttgccacagttgtgtcttacgaccgcgcaggttacgcctggtcagaagaagcgaacaccccgcgtacaggcgaaaacattgttcgcgaactgcacaccgcgctgaaaaacgctgacattcgtccgccgtacattctggtgggtcacagcctgggtggcatgtacagtcgtctgtacgctcagacctaccgcgacgaagtggcaggcctggttctggtggacgcacgtccggaaaacgacgcccgtcgcacaaacaaaatttacgcgaaagaacgcccgaaagctaacccgagcccgctgattagtattctgctggaaaaatctggtgcttttcgcctgtttccgaactttatgctgacaggccgtgttgaataccaggaccgcaaatcatttgttaacattgtggcaagcagtaaatactttcgtagcgtggcagaagaaggtgacctggccagtaccacagaagacgcgattcgcggtcagcacctgggcaacctgccggttcgtgtgattgcgcgcggtattcagcaggacctgacccagtttggtatttctaaacgtggcaacgaccagattgaacagtcatggcagatgggccagcgcgaaatgctgaacattagcacaaacagtaaactgattgttgccaaaaaatctgaacacatgattattcacgaccagccgaaactggttattcaagtgattcgtgaactgattaccgacacatctcactttcagtctaccacatcaaaagcgtttaccgacgaccaccaccaccaccaccactaataagaattc

SEQ ID NO: 4274 - DNA, 1325 bp, Artificial Sequence
  Optimized for E.coli
ccatgggctgtgaagacgacgcatcaccggctctgcgcggttcacagtgtgctctgatggacgttccactgcgtcacgcagacccaagcggcgaacacattagtctgtttctgcgtcgcattccggcgtctgctgacaccacacgtcgcggtgaagtgtggctgctgtcaggtggcccgggtgaatctggcgcctcactgtacccgctgattcagacataccagcgcgcgtttccgggctttgacctggttattccggaccaccgtggtaccggccgtagcagtcgcatttgtccggtgcaggaaagcccggaaagtccggaaggtacaggcctggctggtacagaatggggtccatgcattggtgctatgtacgcaaacctgcagcgcacatctgctttttcaattaccgaagcagcccaggacctgggcattctgatgtctgacgcagaccgttcaggtccggttctgctgtacggcgtgtcttacggtacacagctggccctgcgtgcgctgcaggttaacgacctgcgcgtggacggcctgattctggacggtctggttccgccggaaaccacagaaacatttgacctgtcacgtcgcaccgcactggttgaccaagtgggccgtgacagcatggacgaacgcagtctggaacgttaccgcaccctgctggctgttaaagacgcaggttggcagaaagaagttccgggtggcgacgtgcgtcgtttctttgcggctctgctgagctttccggccctgcgtgaccgcattccgcgtattgttcaggacctgtctgctggtgacgaccgcagtctggttgcgacagtgaaagactggaacgttgcactggcccagctgggtcagggtggcaacaaccagccagctctgccactggtgatgctgattgcagcctctgaaaacaacgcacgtccggaactgggtatggcgaccgttaacgaagaagctaaagacgcactgtttgtgagcccgattccggacctgctggttaacggcagtgtgccacgttacccgcgcgacgcttggtttggtaccagcccgcgtacactgccacgtaccctggtgattcagggcacactggacccgaacaccgcgtacgctggtgcaaaagaacacgcggctacactgggtcgtagtggcccggttacctttcacacagtggaccgtggtgcacacctgctggccctggttgcgccgcgttgttttgttgcagccgtggactcttttattgaaggtgctgtgatttcagaacgttgcgcagaaccgaccccggaacaccaccaccaccaccactaataagaattc

SEQ ID NO: 4275 - DNA, 752 bp, Artificial Sequence
  Optimized for E.coli
ccatgggtacccagacagttgacggccagccgtaccacttcggtttcaaaaaatctaaaggtggcgaactgccgtcaattgcgcaggaaggctttatgcagctgattgaacgtcagggtggcatttttctgggtgacaccaccaagaaagaactgtttctgacctttgacaacggttacgaaaacggctacacaccgaaagttctggacgtgctgaaagcaaagaaagttccggcagcatttttcgttaccggccactttgtgaaagaccagccggacctgatgcgtcgcatggcctctgaaggtcacattattggcaaccactcttggtcacacccggacatgagcaccattagcagtacagaaattcgcagtgaactggaccgtgttcgcaacgcgtctgctgaactgaccggccagaaagaaatgaaatacgtgcgtccgccgcgcggtatttttagcgaaaaagcactggccagttgtcgtgaagcaggctacaccagcgtgttttggtctgtggcctacaaagactgggacaccaacattcagcagggtacagactacgcgtaccgccaggttattggtcagctgcacccgggcgctgttattctgctgcacagcgtgagtaaagacaacgcggaagctctgggctcaattattgacgaagcacgtaaacagggttacgaatttaaaagcctggacgacctgaaagtgaaacactaccaccaccaccaccaccactaataagaattc

SEQ ID NO: 4276 - DNA, 1694 bp, Artificial Sequence
  Optimized for E.coli
ccatgggtaacattaccgctcagcagtctgcaacaattctgaaagctttttctgacgcatcagccaccgactttcgtcagtttctgggcagcgtggcaaaaagtgaactggcgaaaaccgctaacctgggtccggcaatttctgcctttctggacaacaaaacactgtcagccgaacagcagaacgaaattaaccgtctgctgggcatttacgcgcgcgtgaaatacggtaacgcagccaccgaaacactgcgcgaactggttgctattccgacctttcaggtggaaggcgttgcacagcacgacaacccggaatttatcaaaatcgcagacaaaatcaaaggtctggcgcaggcttttaacctgaactttcgtaacattgacaaccgcgtgtacgaaatttctctggaaggttcaggcgacgaagttgtgggtattcacgcacacgctgacgttgtgccagtgaccccggaaaactgggttctgaaagacggcaccaaactggacccgtttaaagttacactgattggtgaccgtatgtacggtcgcggcacagaagacgacaaaaacggcattgttgtggcgatgtacgctatgaaagtgatcaaagaagaaaaactgccgctggcccgtaactttaaactgctggttgacaccacagaagaaaccagcggtgacgcgattccgtactactttgaacacaacccgacaccgaactacaacctggccctggacggtggctacccggttgtgattgcggaaaaaggttacggcaccgtgatgggcaactttccgcgtcgcgacggtgaaggcaaaggtgctgaaattatttctatgaccggtggcatggcaacaaaccagattccgagcgcaagtgttgccgtgctggttacagacaaaccggccgaactggcggcttcactgcagaaagcgggtgctgactacgccaaacgcaacggtggcaactttgaagtgaacgcgaaagttgacggcaaagacgtgaaactgaccgtgacaggtgttagcgctcacagcagtgaaccggaaagtggcgtgaacccggttgcacgtatgctggactttattcacagcattgacggtaaagttgcactgaaacacaaccacattaccgacgcagctcgctacgctgctgacaactggggcctggactacctgggtggcaaactgggcgtgggttttagcgacgcttttatgggcccgctgaccacaagtctgacctttgttggtatggacgacaaaacatttaaactggccgtgaacctgcgtgttccgaaaggcgaaagtccggaagcgctgaaagctaaaattgcagacaaaattggtgcgtggagcaagaaaacccacgttccggccacctttacatactcaattgcggaaccgatgtaccgcaacccggaaggcgaatgggtgaaagccctgctggcggttagcaccgaaaacctgggtatggaacacaaatttggctcttcagcaggtgccacaagtgtgcacgaactgccgaacggcgttcagtttggtctggcacgtccggaagtgaaatacaccggtcacacagacaacgaatttaaaaccgttgaccagtttctgctggacctgcagattgtgacagaaatgatgggccgcgttggtcagctgccgaaactgcaccaccaccaccaccactaataagaattc

SEQ ID NO: 4277 - DNA, 1004 bp, Artificial Sequence
  Optimized for E.coli
ccatggttggtgaaggcccgaactacgacggtaacggccagattaccacatctaaactggccacctacgaccagatggtgtcatttctgaaagaccaggacgcccgtcagagcgcgatggaactggaagttattggtcagacagtgaaaggccgcgacattcacctggttaaatacatttcagacccggcgaaaccgaccattctgtacctgacacagcagcacggtaacgaacagctgaccacagaaggcgccctggaatttgtgaaacacctgggtaccggcaaaagcgcggacattctggacggtgttaacattctgattgtgccgatgctgaacgccgacggtgcgatgggcgacgttaactttccgctggacgactacctggctaaaggcgaccgtaacatgacccgctacaacgcagaagaagttgacctgaaccgtgaccacgtggctaaaattcagccggaaacacaggcactgcacaacaacgttatgcgcaaatacaacattgactacatgattgacctgcaccaccagggtacccgttctgaacgcgacggtgaactggtgagcggcagtattctgtacccgaccacaccgaacgctaacccggcagttgtggaaaaatctaaacagctgggtgctgttgtgtttcacaacgttgactctacaggttggggccacctgggcaaatacgtgggtggcagcgcagaaaccattagtcgtaacggtattgctgtggaatacggcattgcaacactgctgtttgaaatgcgtggcatgtcagaccactacctggacggttacgcactgggcctgcgcagcaacggctacctgattaaacagaccgttaccacactgacagcaacagcagctgctattgctgacggtagtattgctggcgcagacacatctttttgggactcactggcaacacagacatctcgcccgggtggcgaagctgacgacgaacaccaccaccaccaccactaataagaattc

SEQ ID NO: 4278 - DNA, 1349 bp, Artificial Sequence
  Optimized for E.coli
ccatgggcagcaacaacccgctgctggaactgatgtaccgtggtgaaagtggcgcagccggttacaacgcatacaaccgcggcacctacacagacgacgccggtaaagaacgtattcgcggcccgaacggtccgattgacttttctcagatgaccctgggtcaggtgatggaccgtcaggctctgccaaacggtaacgacgaccgtgtgtttgctgttggtaaataccagattattccgcagaccatgcgtggcgcggttgctgaaatgggtctggaccgcaaccagccgtttacaccggcactgcaggacaaagtgttttcagaatacctgattgttgacaaacgtccggaaattgcggactacattaccggcaaaccgggtgctacactggcagaagcccagcacggcctgagcaaagaatgggcgagttttggcgacccgaacaaaaacggtgctagccactacggtggcgcaaaccacgcctctattaccctgcagcagtcagcggacgctctgaaccagatgcgtacagaatacaaagcgaacattgacaaaggcctgagtccggcagacgcctggaaagctaccacgggtgacgacccaaaccgtaccctgccagcaagcattacaagtccgggtagcagtcagcgcgcaccgcgtgacgcgatggctgacggtgtgctgaaaccggacgaacgtggcccggccgttaccagcctgcaggaacagctgaacaaagcgggctttcgcgacgctcagggtaacgaactgaaaccggacggccactacggtaaacacacaaaagaagcggtggaagcttttcagcgtgcgaacaacctggaagttgacggcaaagcgggtccgaaaaccctggaagctctgaaaaacgcacagccagctggtccacagacagaaaaaccagctgaaaaaccgggtgaagtgcagctgagcaacccagcacacccagaccacgccatgtacaaacaggcagttgccggcctggaaaaactgggcccgcaggcaggttttaaagaccacgctgctctggaacgtgcagctggtaccatgacatacgaagcccgcgtgtctggtatgaccaaaattgaccacgttgtgccgaacgcatcaggtacaggcctgtttgccgttcagggtgaactgcgtgacccggccagtcagcgcgttgtggttgacaaagcgcaggcttcttcacagtctattgaacagtcaacccagcagctgaaacaagacgcaccgacccagaaccagacacaggaaccagcacaggaacgtcagcagccaaaaacaatgatggcgcaccaccaccaccaccactaataagaattc

SEQ ID NO: 4279 - DNA, 1727 bp, Artificial Sequence
  Optimized for E.coli
ccatgggtaacaacgacggcgtgacaaacctggcactggacccgaccagcagtgcccagtcagacattattagcgacgcagtttacaaaattacagcccagcactcaggtaaaaacctggaagtggaaggtggcagcaaagacgacggtgcaaacgttcagcagtggaccgacaacggcaaagaacagcagaaatggcgtgttgtggacgtgggcgacggttactacaaactgatttctcagtcttcaggcaaaacactggacgtggcaggtggcaacacccacgacggtgccaacgtgcaacaatggactgacaacggcaacgcgcagcagaaatggaaaattattgacgcaggtggtggttactacaaactgatctcacagagcagtggtaaagcactggacgttgtgggcggttacacacacgacggtgccaacgttcagcagtgggctgacaacggttctgctcagcagcgttggcgctttacccagattgacaccacagctgacaccacaccgccgacagctccaaccaacctgcagtcttcaagcaaaacaagtacctctgtgacactgacctggaccacaagtaaagacaacgttggtgtgacaggctacgtgatttacaacggtacagacctggttgacaccagtaccacaacctcttacacagttaccggcctgacagcaaacaccagctacaactttaccgtgaaagccaaagacgcagccggtaacgtttcagaaccgagcaacgttctgaaagtgacaaccagttctgactcaagccagaacacaggtttttacgtgaaaggcacaaccctgtacgacggcaaaggtaacccgtttgttatgcgtggtattaaccacgcttacacctggtacaaaggccaagaaagtgtggcaattccggcgattgctaaaacaggtgccaacaccattcgcattgttctgtctgacggccagcagtggacaaaagacgacctgagtgccctgcagaacctgattaccctgtctgaacagaacaaactggttgtgattctggaagtgcacgacggcaccggttcagacaacgcggctgttctgaacaaaattgcggactactggattgaaatgaaaagcgctctgattggtaaagaaaacacagtgattctgaacattgcgaacgaatggtttggtacctgggacggcaacggttgggctcagggctacaaatcagtgattccgaaactgcgcaacgcaggtattaaaaacaccattatggttgacgcagccggctggggccagtacccgaaaagcatttttgactacggcacacaggtttttgacgccgacccgctgaaaaacaccatgtttagtattcacatgtacgaatacgcaggcggtaacgccgaaaccgttaaatctaacattgacaacgtgctgaacaaaaacctggcggttatcatcggtgaatttggcatcaaacacacaaacggtgacgtggacgaagcgaccattatgagttacgctcagcagaaaggcgttggttacctgggctggtcatggaaaggcaacggtagcggcctggaatacctggacatgtctaacgactggggcggtagttcttacaccgaacagggtcgtgcgattattgaaggtccgaacggcattcgcgctacaagtaaactgtctaccgtgtactcaagcggcaaacagcaccaccaccaccaccactaataagaattc

SEQ ID NO: 4280 - DNA, 428 bp, Artificial Sequence
  Optimized for E.coli
ccatgggcaccgaatctcgtcgcccgtacggtgcaccgcagccagaaccgattgacgacaacgaagaccgtatgggcagcatggaagaactggactttgacgaagaagaaccaggtgcacgtgttggtgacccggctagcagttctgtggaacaccgtaccccgcaccgccacattcacggctcaagcctgaccggtaacgctgaagacgaaccgaacgacgacgacctgacaccggaaaacctgattcgtgaagacggtgcacgtagtgcacacgaagctggtgaagaccagccggcagactgggacctgtctattgttgacgaagacgacattggtggcggtaacggcctggacgaagctgaactggcacagcgtgacccgctggacggtaaaccgcaccaccaccaccaccactaataagaattc

SEQ ID NO: 4281 - DNA, 449 bp, Artificial Sequence
  Optimized for E.coli
ccatgggtagctggcgtaaaagtacccagtttggtggcgacggtggctctccgttttcagacgacctgacaaacgttaaacgcctggcaggtttttacattcgtcacggctctcgcattgacgcgattcagggcatttacgaatactcagacggtcgtcgcaccccgcagggttttcacggtggctacggtggcagccacaacatcgttttctttgaaaacgacgaatacatcatccagatcaccggtcgtacagaccgtcgcgtggaccagctgacctttaccacaaacaaacgcacatacggtccatacggtggcgacggtggcaacccgtttgaaattgacgcagcccacattagcggtttctttggccgtagcgcgagtgaactggacgctattggtttctttattccgacagtgcaccaccaccaccaccactaataagaattc

SEQ ID NO: 4282 - DNA, 341 bp, Artificial Sequence
  Optimized for E.coli
ccatgggtccgaaccagggtggcagcagttttaccaaccagggttttaaagcaagcacaggcaaccagtttaaagcggaatttgctcaggacaacaccgttggcgttgtgagccagaaagtgaaacagtctgaacagaacaaaattcaggacaactttcagacaccgaacgaaaaatacgacgaagaatttgcaaccgaccagggtggcacaggtgcagttgcccagaaagtgcagaactcttcacgtaacaaaattcagaacaacgcgcagaccccgaacgaaaaatttgacgaaaactttaacacaaaacaccaccaccaccaccactaataagaattc

SEQ ID NO: 4283 - DNA, 524 bp, Artificial Sequence
  Optimized for E.coli
ccatgggtaaaggctttaccccgggtctgtttgaccgcctgatgggtggcgacaacacaccggcacagtcagacctggttgtgcgtctgagcatggacgccctgaaagacaccgttgcgcgcgacctggaagctatgctgaacacccgtacagtgattccggaagaactgctgaaaaactttccggaatgtagcaaaagtattctgacatacggtctgaacgactttagcggcatgagtctggcatctctggacgaccgcgcccacatttgtcagtgcctggaacagggtattgcgcgtcacgaaccgcgtctgcgcaacgttcgtgctagtctggaactgcgcgaaggttctattaaccgtctgaactttgcgattgcagccatgctggttgtgggcccggcgaaagaagctgtttcatttgacgcagtgctgcagccgagcaccctgcagtactctatttcacgcgcacgtcgcgccatgcgtatggacggccaccaccaccaccaccactaataagaattc

SEQ ID NO: 4284 - DNA, 509 bp, Artificial Sequence
  Optimized for E.coli
ccatgggtaccacaagctactgtggtctggtttggggcagtctggcagaaaccgaccagcgttttagcaaaaccacagttaccaacgtgcgtacaggccagcactactgctttgaccgcatggtgctggacctgaaaggtccggcaacaggctacaacgttcgttacgtgccacgtgttgtgcaggacggtagcggctttacagttccagtgcgtggtggcgcacgtctgcaggttacactgcacgccccgtcttacgacccgtactcaggtgaaccgacctacaacccgccggcgaaccaggctgaactgtctaacgttgccaactaccagacctttcgccaggtggcatgggccggttcatacgaaggctacacaaacattggtctgggcgttcgtgcgcgcctgccgtttcgtgtgtttacactggacggtccgggcagcaacagtcgcctggttattgacgtggctcacttttggcaccaccaccaccaccactaataagaattc

SEQ ID NO: 4285 - DNA, 941 bp, Artificial Sequence
  Optimized for E.coli
ccatggaagaacacggcaccccggttcagaaaacaattgacctgaacgaaggttttgacaacagcaacgaagcgagtaccgaaccgctgtcactgaccagcgaagaagcaacaagccaggccaccgtgacagcgattgaccacgacgcgaactttagcccgagtaccctgcagtttctgaaagctaacacaggtctggacggcgaacagtgggacaacattatgaaactggttaacaaaccggaacaggacagcctgaaatggaccgaattttacggctacgcagaagacattggcgacaaccgcggttacaccattggtatttttggcgccaccacaggtggcagtaacgacacaggtccggacggcccggacctgtttaaagcatttgacgcagccagtggcgcttctaacccgtcaattgcaggtggcctgacccgtgccggtctgaaaggcaaaatgtctggttcaattctgaaactgagcgacagtgactctgtgattaaaaagaaaattaacgccctgcagaacaacgaagcttggcgtgaagcaatgtggcgcaccttttacgacacatacattgaatactctgttcagcaggcacagaaacgcggctttaacaccgccctgacaattggttcatttgtggacaccgccctgaaccagggtgcgacaggcgactcaggtagcctggaaggcattctgagtcgttctggtagcagtaccaacgagaaaaaattcatgacatctttctacgcgaaacgcaccctggttgtggacacaaacgactacaaccagccgccgaacggcaaaaaccgtgttaaacagtggtcttcactgctggcttcaggtgaaaccgacctgaaaaacgcggacgcggctgtgattaaagctacaaactgggaactgaaacaccaccaccaccaccactaataagaattc

SEQ ID NO: 4286 - DNA, 1481 bp, Artificial Sequence
  Optimized for E.coli
ccatggctccagcatctgcagcaccaacagctcaggctacacgttacgtttctgaagcgggtgtgacagctcaccgtgctgctgttgtgaacgcagctgctgttaaagcgcaggtgccaagcacagctaacccgctgccgggtctggacccagcaggcgacccggccaacctgagcgttctggtgaacaaaagtcgtccgctgaacccggcaacctacgcaccagcagacctggttaacgcacgtggtagtggtcaatacctgcgcgctgaagctgcagcatggctgaacggtctgtttcagggtgctgctgacgcaggtacaggtggcctggccgttgtgagcggctaccgtagttacgcgcagcagcagcaggtttacagcagttacgtgaacctgtacggtcaggcgcaggctgacctgatttctgctcgcccgggctactcagaacaccagaccggtctggcggttgacgtgggcaacgctaacggctcttgtggtctgtcaacctgctttggtgacacagcagccggcatgtgggttgcggctaacgcctacaaatacggttttattgtgcgttacccgaacggttacaccaacattacaggctacagctacgaaccgtggcacctgcgctacgttggcgtggacctggcgaccgacatgaaacgtcgcggttttgctacactggaacagtactttagcggcaacccgagtgttcacgcatctattacctcaggtgctgacctggtggcagctgacgctgctggccgtctgctgcgctacccagctctgccatctggtggctacggtgttccggtgcagattggttcaaactggaccggcctgaaacaggcgtttgttgtggactgggactctgacggtgtgtacgacctgctggctcagtggaacaacggcacactgggtctgtttaaaggctggccgggtggcgcattttcaacccagattgttgtgggtacaggcgactgggacgccatgaccattacagttggtaaatggtcttcagaccagggctacccgggtgttgtgggctactttccggacggtggcctgcgctactacccgaacacctctggtcgtgcgctgacataccgtgtggacattggtacaggttgggctggtctgggcctgacaatggctgactgggacgcagacggtgccaacgacattctggcaaccacaagcagtggcctgctgctgtcatacccgggtaacggcgttggtggctttaagggtcagccgtctattattggttcaggctggggtaccatgaaagcactggttccgggttttggtctgtctggtccaggtacacgtagtattaccgcccagacagttgacggttacctggtggactacggcctgggtctgggcgtttggggtccacagcgtcaagtgggtaacggttggggtagtatgaaactgtttaaacaccaccaccaccaccactaataagaattc

SEQ ID NO: 4287 - DNA, 476 bp, Artificial Sequence
  Optimized for E.coli
ccatggttgaaaccctggacggtaaagtgatcgaaaaaatcctgatcctgaaaagcagtcaccagctgcagctgattaacgacggccgtccgctgaaaacctaccgcattagcctgggtaaacgtccgaaaggcccgaaactgatggaaggtgacaaacgcacaccggaaggcttttactgggttgactggcgtaaaattagcgaccgctttaacctggcgatgcacattagttacccgaacatttctgactcagcacgtgctcgtcgcgaaggtgtggaaccgggtggcatgattatgattcacggcaccccggacagcgaagacacaccggaagacctgtttcacaccctggactggacagacggttgtattgcaatgcgtaacatggacatgcgcgaagtttggaacctggtgccggacggcacaatgattgaaattcgcccgcaccaccaccaccaccactaataagaattc

SEQ ID NO: 4288 - DNA, 497 bp, Artificial Sequence
  Optimized for E.coli
ccatggcgaccagctactgtggcctggcttggggtagtcaggacaaaacagcgccggaaatgagcagtgctagcgtgaccaacgttcgtacaggccagcagccgtgctttgaccgcatggttgtggacctgaacggcccggtgaaaggttacaccgtgcgttacgttccggaaattattcaggacggtaccggctttacaattccggtttacggcaacgcacgcctgcaggttgtggttaacgccccgtcttacgactcaaacggtgtgacatacaacccggcagccaaagcagaactgtctaacgttgccggctaccagacctttcgtcaggtggtttacgcgaactcatttgaaggttctacatcaattggtctgggcgtgcgtgctcgcctgccgtttcgtgtttttacactggacggtccaggttctggtagtcgcctgattgtggacgttgcacacttttggcaccaccaccaccaccactaataagaattc

SEQ ID NO: 4289 - DNA, 2513 bp, Artificial Sequence
  Optimized for E.coli
ccatgggtaacgactaccagagcgaaattgccctgattcgtcagagcaacagtctggaagacattgctagtattgcacgccagcacgcagccaccacagaaaaagaaggtggcattctgtactctcgtccgattggcaaagttagcagtgagggtgcggctgtgtctctgtcaaaagaaaccggcctgccgattattaacgacacaccgcgcgctaactttctgtcagacgaagacgttcgttcttcaattgaaaagaaagcacgcgaaatttttgaagacctgggtcacgacccgaccacagcgcgtaaaagcgctaacagttttctgtacggcgacccgaacgtgccatctcaggacccgaccagcctgagtcgctgtctgtggggtgaagcatcacaggaatttgccagcagtctgcgtggcgacattaaagttgtggccagcgcagccaacctggaacgcgtttttggtcaggttgaagtgccggcggttctgaacaacccaaacgtgaccagcctgggtggccagccagtgccaaaactgcaggcactgtacgctcagggtggcgctagtgcagttctgccggaagtgcagacacagtttattcaggcggctccgaaaggtatttttaccacagctgaaagtattggcaacgaagttaaagacgtgacctttagccgtgaatttgcaggtagttttgacctgaaagaaacacactttcgttcttcagcagaactgtctgcctcaggcatggtgcgtgcaccgacaggtctggacgtgccagcagcaaacctggctgaaacagcactgacagctgaagctgctgcaagccgtcgcctgagtccaggtacagtgcgcggtctgggcgttgttggtgctgctgctgcagtttacgacctgggtggcaccgtgcgtaacacagaacgcctggacgcacagggtaactctacagctgctgacgcagaagtgacccgttacgccacacgcaacctgggcacatttggtggcgcgatgctgggtagcagtgttggcgctgcactgggtgtggaatctggtccgggcctgctggttacaggtgcagtgggtggcattgttggtgccgtgggtggcgacaaactggcggacgttattaacgaccaccgtattagccaccagcaggacgcccagggtaacacctggcgcctggaaaaccaccaggcgggtgaacgttgggctcgcgacgttagtacaggcgaaattgacccggccgcggttgcgtttggtgaagctggcgtgccgctgtacaaaacccgtacagaactggcaaccccggaagtggccgacctgctgacctttaaagcttctcgcacatcaattgaactggcactgggtagcccgccgcagaacaaagacccgtacacccagccggcgaaagaacacgacacacgttctctgcgcgaatcaccgtggctgcacaacgccaacacccagcagtggacacgtcaggtggcggacggcctgattgaccgcacaatgtctacccacacagaaaccgcgtctccgcagcgtgcttcacagctggacgaagcctcacgccagattattaaacagaacgctatgcacaccccggctgcaatggccgcgcactacaaagaaacatacgaacagaacggttgggaacgtcacgcttacatgccggctgcagttcacgacgcactgaaacacccgggccgtattgtgggttctgacggcgacctgtacgaacgcggtaaagacggccagtggacccacgacggtatgctgtgggactcacaggcaaaaggcaacctgaaacaggaactggacggtacatacgctgctcagacactgggtacccagcgtacagcagcacagccggttgcacagacagctgctgaaccaattaaaaccctggaaacaattcacgtgaccgcaccgcgtatgcagaaccacgacaacgcggacacatctagcaagaaaacccaggaagacacagacgttcgtggtcactctgctccaacccgcccgcaggcttcaggtccacaggacccggaccacccggaccacccgatgctgaaacagattcgtgaaggtgttgcgaaaattgacgaaagcgtgggcaaaccgtacgacgaaatgagcgaacgtgttagtcgctgtctgctggctgcatgcaaagacaaccgtgaacgctacccggaagctggtaacaccagtctggctgctaacgcactgcagcgtgttgaccacgtgctgatgggtaaaaacggcaacctggtggcaattgaaggccgtattgacgacccgacacacaaacgcgctgcaattccgattgaccaggctattaacatgccgctggaacagtctgacgcaaaactgcaggccgcgaaccaggccattgcgcaggaacagacacagacacgccagcaggaactggcacgcagccagcagcaggacacccagcaggcgccgcgtgtgagttttcaccaccaccaccaccactaataagaattc

SEQ ID NO: 4290 - DNA, 677 bp, Artificial Sequence
  Optimized for E.coli
ccatgggcgaactgctgctgttttctcacgaagactttcgtggcgaacgcgttaccattgcggacggtgcagcctcaaactttacagactttggctttaacgaccgtgctagcagtattgttgtgcgcagcggtacctgggaactgtgtgaacacaaagactttggtggccagtgcgcggtgtttgaacgtggcgaatacccgaacctgcgccagtttaacaaccagttttcttcagctcgtgaaattcagggtggccgtcgcgaccgcggtaacagcggttacggctacggtcgtgacgaccgcgactaccgtgactaccgcgacgaacgtcgcgaagaacgtcgcgacggccgttggatggaagaccgtcgcgaggagcgtcgcgactaccgtgaacgcggtgacgcagttgaaatgtacaacgacgtgggctttcgtggtcgccacgttgtgattaacaacgacatgcacacactgcgtgacgttggctttaacgacaacgcaaacagtctggttattaactacggtacctggcaagtgtgtgaacacgccgactacggtggccagtgccgtacatacggtccaggtcgctacccgaacctggaagactttattgaccgtattagcagtattcgtcgcgtgcgccaccaccaccaccaccactaataagaattc

SEQ ID NO: 4291 - DNA, 287 bp, Artificial Sequence
  Optimized for E.coli
ccatgggtcgcgtggacgctggtgacgtggctaccagcgctggtgtttctgcttcactgtacagtacattcaaagacgacaaaatggttatcccggcgcgcgacgacgctagcagttttgtggcatctggtggcgccattcgtggtgtttacctggaatcagtgctgcagaaaattcgccaggaaaacccgggcctgaacgcaagcgacgaagaactggcacgtgccattctgacccagcaggcacagccggccggccaccaccaccaccaccactaataagaattc

SEQ ID NO: 4292 - DNA, 1934 bp, Artificial Sequence
  Optimized for E.coli
ccatgggtcaccaccaccaccaccactggagcgacctgaccgtttttggtgacagcctgagtgacggtggcaacgtgggccgttttacctacgacggtgccacacacccgctgtacgacgaaattgttgctcagtctctgggtgacaacctgcgcccgagcagtcagggtggctcaaactacgctgaaggtggcgcagttgctgtgccagcaattaacccgctgtttaacacacaggaccagctggacaactacctggcagcacgtggtggccgtgcagacccagacggtctgtacattcactggattggtggcaacgacctggctgctgcagcactggctccgctggctgctcgtcagattgttgacaactctgcatctgctgctgcttctcaggtgagtcgcctgctggacgctggtgctggtaccgttattgtgccgacagttccaaacgtgggtgctaccccggctctgctgcaggcaattctgcaggtgctgggtccagctgcacagccagctacagcagcgctgtttcagagcctgagtaccacaaccacaccggaccgtgctgcacgcgaacaggccattgaaaccgctctgggtgaagctgctggtcagatttcttcaattccgctgattcgtgacgcaattgcccagcagctgattgctgcatggcagctgctgtctcaggaagccgcggctctgacagaccgctacaaccaggctgaagaacagggcctgatggcagcccgtggtaacattgcacgcgttgacattaacggtctgtttaacgaagtgattgacaacccgggtctgtacggcctgaccaacacagcaggcatggcctgtccgccgggtgtttcagcgatggactgcaccagcagtaccacaggcttttctcagtcacagcagtacctgtttgcagaccgcctgcacccgagcccagctgtgcacgctctgattgcagactacattcagagtgttctgaacgccccgctgcaggtggctgctctgtctcgtgcaccatcaatgctggttggtgacgcgcacaacacactggacggtcacctgcagcagcagcgtcagcagccggcgaacgctggtgaatttacagtgtttggtggctacgctggtcagcagcgtgactttcgcggcgacagtctgcaggacggtgacgcaaccagcgctagtggtacagttggtgtgggctaccagctgacagaccactggcaggcaggtgccatgctgtctaccacatcacagcgtcaggacccgtcttcacgctttgactaccgtctgcgcggtaacctggttgccctgtggagccagtttaactacctggaccgcggctggattaacgcggacgctcactacgccgacctggactttgacgacattgaacgtcagattcgcctgggtccggcgacccgtacagaaaagggtaacagtgacggcaaagtgctgggtatgcgtctgcagacaggttgggacctgccgctgggtagctacgttagtaccggcccggtggcttcttacgcactggactacacacaggttgacggctacaaagaagaaggtaacagcagtacctcaatgcgttttggtgaccagacactgcacagccagattggtagtgtgggctggcgcattgactctaaagacctgctgattaacccgtgggcacaggtttcatacaaccaccagtttggtgactctgactcagccgtgaccgcgggcctgaaaagcacccgtacagcttttacacgctcttcagacgcaagtgacgacaactggattgacatggctgttggtgcatctgtgccgctgggcacctcagttaacgcatttgccggtgtgagcgctattaccggcaacagtgacatgcaccaggttacatggaacgtgggtctgaacgcccgtttttaataagaattc

SEQ ID NO: 4293 - DNA, 2264 bp, Artificial Sequence
  Optimized for E.coli
ccatggcaccagcagctgctgactctgcaacctcaccggcccgtccgcgtattggtctggttctgagtggtggcggtgcgcgtggctacgctcacctgggtgttctgcaggccctggaaaaaatgcacattccgattgactacgtggctgcaacatcaatgggcgcggttgtgggcggtctgtacgctagcggtctgagtgttgacgaactggaccgtattctgaccggcacaaacctgagcgacattgcatttgaccgtaacgaacgtgctgacctgccgcagagtcagcgcgaagacgactaccagtacccgattggtctgtcagccggttacggcgacggtaaactgaaactgccggcaggcctggtgcagggtaacaacctgctggccctgctgcagaactggaccccgcagctgccagcgaacattagttttgacaaactgccgaccccgtttcgtgccgttgcgacagacctgggctctggtgctgaagttgtgctgtctcagggctcactgccgcgtgctattcgcgcaagcatggccgtgccaggcctgtttgcgccgctgaaactggacggtcgcaccctggttgacggcggtctggtgcgtaacctgccggtttctctggcgcgctcaatgggtgctgacattattattgcagttaacattgccacagacctgcaggacccgagcaccctggaaagtccgacagctgtggcacagcagatggttaccattctgattcagcagaacgtgaaacacgaaattgacacactgaaacagcaggacgttctgattgaaccgaacctgggcgacctgagctttgcggactttagtcgtggcaaagacggtgttaaagctggttacgacgccgcggaacgccagtcagcaaaactggctgcactggcactgccgccgcagcagtggaaagaatacctggctgctcgtagtggcggtggcccagtgctggcgcaggacacccacattgacgctattgaaattcgctctaacggtcaggtgccagctgcagttgtgcgtcgcgcactggacgttaaagaaggtgacttttacaacccggtggccctgaacaaagacgttgcgcgtctggctacaaacggtgactttaaaagcgtgacccaggaactggttacagaaaacggccgcaacgttctgaaagtggacgcagacgacaaatcatggggtccgcactttctgctgtttggcctgggtgttagcaacaactttgacggccgtggtgactttaacctgcagattggccaccgcctgccgtggctgaccgaaagtggtctggaatggcgtaacgacgcagtgctgggctctaaacaggcctcactgcacaccgaactgcgccagccgatttggaacacagttggtctgtacgtggcaccgtacgccgaatacggccgtcgccacattgacctgtacaccgacgagggtgcggtgacctctaaaacagttccggtgacagcttaccgtgttgacaccacacgcgttggcgtggacctgggtattccgattggccgtctgggtgaatttcgcgcgggcgttaactaccagtggctgacagctgctccagcttacaacctgccgacagaatttgctaacctgattggtgtggacaccatttttgacaaatttcgtattaaccagccggttgtgcgcgcacagctgacaattgaccagctggacgacccgctgtttccgcgtaaaggttactacctgagcgcagttagtaacattggcctgggtggcgctgcaaactcttactcagacgcccagggtaaagctctgtgggctggcagccgtggtcgtaacacagtgaacctggctctggaagctgctggtacctacggtaacgaaacaaacgacgcttctggcaacggtggcctgggtttttcactgggtggctttcagcacctgtctgcatacgctccagaccagtttaacggcaactacctgctgtacggtcgtctgacctacctgcgcgacatgccggaactgaacctgccgggtctgcgtaacaccgttctgggcacatcactggaaatgggtgacatttggcagacccgcgaagcatttggcacaggtagctacaaaaaatctgccagtgtgtttctgggtggcagcagttttctgggcccgctgtactttggtgctgcaattgccccgcgtggcgtgtggaacctgtacctgcagctgggtcgcgtttttcaccaccaccaccaccactaataagaattc

SEQ ID NO: 4294 - DNA, 2843 bp, Artificial Sequence
  Optimized for E.coli
ccatgggctttagcgccctgaccctgggtgttgctgcaccagctgctgcagctgtgccgccgtgtccgggtaccggtggcgcgatgcagattgttgctcacacagacgacgacctgatttttatttcaccggactttatgcgtgacattcagagcaaacgctgcgttcagacagtgtacgctaccgcaggtgaagcaggtgaaggcgcggcttactggaactcactggaagccggtattcgtgctagctacgcaaaaatggccggcgttgctgacgcttggacaacatcagacgcgggcgtgccaggtcgtccgctgaccctgcagacactgaacgcagccccgaacgtgagcgttgtgtttatgcgtctgccagacggttttccagacggtcgtggcagcagtcgctacaacggtcagagtattctgaaactgtgggacggccgtctgtcttcaattcgcccggttgacggcgcggctgcatttaccaaagcgcagtttcagaccacactgaaccagctggttgcaaactaccagccgaccacatttcgtacacaggactggaccggtaactaccaggacccgtacgaccactctgaccactgggctaccgcaaaatttgcgcagctggctagtcgcgcatacacaggtccacacacagcatctgcttacgacgcatacgttattgacgaatacgcgcagaacgtgacaggcgctgacctgaccaacaaagttaacacatttgtgcgttttgcggactttgacaaatacctgtgtgacaccccgtgcccagctccgccgtacagtgactggctgaaacgccagtacattaccgcaattgaatggacaggcaacgccgcgaaaagcgccggtaccacagttagtgcaagcagtcagaaagccagtggccagtctccggaaaaagctcgcgacggttacgcttggggtaccccgatggacgcgaaccgcgaatgggtgacaaacggtggcaaagctggcagttggattcagtacaacttttctccggcacgtaccattaacgccgttacactgtttgaccgcccgattctgtcagaccaggtgaccggtggcaacctggcatttccggacggctcaacagttccggtgggtgccctgccgaacaacggtagcggcctgaccgttaactttccggcccgtacagtttcttcagtgcgctttaacatcaccagcgtgagtggctctaccacaaacattggtctgagcgaatttgaagcccacattacagcggacgttgttgctccggaagttacagctacaccgccgggtggcacctacgacattggtcagaaagtgacactgagtgcaaacgaaccggccacaatcttttacaccctggacggtaccacaccgaccacagcttctgcaaaatacgcaaccccgattacagttaacggcccgctgaccctgaaatactttgcagtggacgctgcaaacaacccgtctgccgttgtgacccagtcatacagcacaggtccggacgttaccaaaccggttgtgacagcgaacccgctgggtggcgcctacgctccaggtaccagtattaccctgacatctaacgaagctaactcagtgattaaatacacaaaagacagcagtgacccgctgaccgcgggtctggtttacagtacaccgattgtgtttgctggcccggacccgatgaccctgaaatttttcgcgacagacccggctggtaacgtttctgacgttgtgacccagacatacaacgtgccgccggacacccgtgctccagttgtgacagctaacccaaccagccgtgctctggcaagtggtgcgaccattacactgtcagcagacgaaccgggtgccagcatttactacaccacagacggctcttcaccgaccgcaacagaaagtgccaccaactttaaatactctgcaccgctggttatgggtacatcacagctgaccctgaaatacattggtgtggacgctgctggtaacaccagtccaattggtacccagacatactctgttccagctgcaggtccgccgagcagtcacgactttaacggtgacggcaaagcggacgtgctgtcttcagacaccgctggcaacctgtacctgtacccgggtaacggtggcggtggcctgggtccacgtcagacagctctggctgctccggcttggagcaccattacagacaccattacaccgggcgactttaaccgtgacggtaaaccggacctgctggcacgtgctggtgacgttctgtggttttacccgggtgacggcgcaggttcatttggtgcccgcgttcaggtgagcacaggctggtcaaccatgagccagctgttttctccgggtgacttttcaggcgacggtattccggacctgattgcacgtcgcagtaccggcgacctgcgtctgtacgagggtaacggttctggtggcctgcgtaccccgattacaattggcaccggttggaacgttatgaacgccattctgtcaaccggtgactttaacggtgacggtacaggtgacgtgctggcacgtcgcagcgacacaggtgcactgtggctgtacccgggtgacggtacacgtggttggctggcatggaaacagattagtaccggctgggacaaccgtacatctattgctggtccacgcgacctggacggtgacaacaaaaacgacgttattggccgcattggtgacaccctgtggctgtaccctggctctggcaacggtacactgtcaaacgtgccgccgacaagcctgggtacaggttggcaggcaatgaaaattattggtcaccaccaccaccaccactaataagaattc

SEQ ID NO: 4295 - DNA, 254 bp, Artificial Sequence
  Optimized for E.coli
ccatggctgaagacgcaccatctgctgacccggaagttaccattcgtacagaaggtgacaaaaccattcaggaataccgccagaacggctttctgtacgctattaaagttacaccgaaagtgggtaaaccgtactttctggtgcgtgcagacggtagcgacggcaactttattcgcagtgaccagccggacatgctgattccggcgtggaaaatttttgaatggcaccaccaccaccaccactaataagaattc

SEQ ID NO: 4296 - DNA, 995 bp, Artificial Sequence
  Optimized for E.coli
ccatggcaccaatgtggccggtgccacagccatacccagttccagacgacccaacagaatctctggctgacctgccgccgggctcagaatacgtggcactgggtgacagctacagtgctggttacggcctgggtgaccgtacccgtctgccaacaagcgcttgtgtgcagagtgcacgtgactacccgcaccgtctggcagcacgttttggcctggacctgaccgacgttacatgcgcaggtgccacctctgaagacgtgaccacaggccaccagtttacaggtgttccgccgcagattgaatcactgagcagtcgtacccgcctggtgaccctgacaattggtggcaacgacgcggacctgtttggcacagcggcttcttgtctggccatttcagcggacggcccggtgtttagcggtcgtgacgctccgagctgcgaaagtaccctggttcaggacggcgaagaccagctgagcgtgaaaattcagagtcgtgttgccctgggtattgctgacaccctggcagctgttcagcgtgctgctccaaacgcggttgtggtttttctgggctacccggccatttttccggacgcggaacacaccccggctaaaggttgttttcgcagtgcgctggacctgggcacactggctggttcttttccgtcagacacctttccgtttacagacgacgacgtggcctacctgcacggcgttcaggaagaactggacgctgtgtctgcatcagcagccgacgcggctggtgttcgttttgtggacgttctggaacgtacagaagcacactctgcttgtgctccagcagacgaacgttacgtggccggcgttagtctgacaggttcttcagacctgcgtcgcattgacctgaaagctggtgctctgcacccaaacggtcgtggtgttgcgtacctgaccgaccagatggctgacgcaattcgcgaactggctggtcaccaccaccaccaccactaataagaattc

SEQ ID NO: 4297 - DNA, 2666 bp, Artificial Sequence
  Optimized for E.coli
ccatgggtcagacaagtggtccacagccggctccaacctctgaagctccgggtggcggtagcagtcagggtccacagccagctggtaacggtccagcttctccgccggtggaatcaacaccgcgtcagggcaaactgccggaccagcaggcaccgattaccggtgtggaactgacaccgggcgttgctagtcagccagctccagacccggctggtaaagctgaagcacaggccaccaaaccgaaatcaatgccaggtgacgcaccagacgctgaaagcatgaaagctgcaatgcgtgctgctattccagcgggcggtgctgaaatgggtcagcgttctccgcgcgttgtgacaaacaaacaggacaaagaagcagctgctccagcacgtggtaaagctgttggtgctgcagtgaaagctacagttccgatggccgctgacacaggtcactggcgcccgacaattggtattcagggtcaggacgtgtctgctcaccagggtaacgttgactggcagagccagtggagtcagggttctcgttgggcttacgtgaaagcaagtgaaggcaactactacctgaacgaaaactacacccagcagtacaacggttctcgtaacgttggtatggtgcgtggtgcataccactttgcgattccgaactggtcttcaggcgcagaccaggcccgttactttgttgcaaacggcggtggctggtctgctgacggttacaccctgccgccggttctggacattgaatacaacccgtacgccggccgcacaattaacggtttttactttggcaacacctgttacgacatgagcaaagcacagctgggccagtgggctgcagactttggcaacaccgtgaaagccctgacaggtcgttttccggttatttactcaaccacagactggtggaacacctgcgttggtaacagcacatttggcagttacccgctgtggattgcgagctactggaacaacccgacaaactcaccgggtagcctgccggctagctggaacgactacagtatgtggcagtacagcagtaccggtccgtttgaaggcgacagtaacatttttaacggtacctttgacgaactgcgtacatttgctcgcggcgtgccaacaccgagtaacccatctattcgctcaggcgctgacgttctggcagtgatgccgtctggtcgtctggacaactttccggcggacggtcagggccgcatttctggtccggttaccattggttcaggctggggtaacgctctgagcgtgcacgttgtggactggaaccaggacggcgttcaggacattctggcgcagtgggctgacggtaccctgcaggtgtttcgtggcacatctggtggcggtttttcaaccccgattcaggttggcagcggttggcaggaaatgagtctggcgaccggttggtggaactcaaaagacgcttttccgggtgtgattggccaggacggcagtggtaacctgtaccgctaccagaacgcatctggcggtgcgctgggcggtggcgttctgattggcaccggttttagcggtcaccagtttaacctgctggactttgacggcgacggtagccaggacctggtgagtcgtaccggcgacggtacaatgcgtctgtttcgctctaacggcctgggttcatttctgacagaaccggcacgcgtgattggcaacggttggtctgccatgacctcagtttcttcagccgcgggttttaacggttctggtagtcagggcctgcaggcacgtgctgcaaacggtgacctgtactactacccggccgttaacggtagctggggcaaccgctttctgacaggcctgggttggaacgacgcactgctgattggtggcgcgccagttaacgtggaagctaccctgggtgtggacgaaccggacgttctggcgattcgtcaggacggcaacctgtaccgctacgctggctctggttcaggtggcctgacaagtccggaactgattggtaaacagtggacaggtctgaaagcgggctttctgaccgactggaacggcgacggtgctctggacattctggcacagtggtctgacggtcgtctgaccctgtacccgggctttaaaggcgcaggttttggcagcccgattagtctgggtacaggctggcaggactggaccctgacagtgggtacctggaaaaaatctgacccgcgtccgagtattgttggttacgacccggcgggccgcctgtttcagattggcaacccatcaggtggcgctctgggtacccgtacacagattggtacaggctggagcggtctggacattgtgcagatggactttgacaaagactcaaacgccgacctgctggcaaaaaccgccagcggcgacctgatgctgtaccgttctaccggtacaggctcatttattccggaagcaccggccgcgattggtacaggctggaacgttattaacagttttggtgccattcgcggctttgcgggtgctggctctaccggtattattggccgtaccacaggtggcgaactgcgctactacccagtgggtcagaaccgtgcatggggtccgacaagcgttattggtagtggctggaccggtctgaaaattctgtctccggcctcacgccaccaccaccaccaccactaataagaattc

SEQ ID NO: 4298 - DNA, 299 bp, Artificial Sequence
  Optimized for E.coli
ccatgggtattgaccaggttgcgtgtggcaaccgtacagactttgctaaactggacattcgcgtgggtcagaacctgggcaccaaccgttgctttgcaaacagcggcgttgtggccgttgaagtgccgaacgtttaccgcgcaagcagtggtaacaacaaactgacagtgaactaccagtctggctcacagtactacacccgtacactgaccccgggtacccacattaactttgcgtctgttgtgcgtgtttacgaagtgcgcatttggcaccaccaccaccaccactaataagaattc

SEQ ID NO: 4299 - DNA, 380 bp, Artificial Sequence
  Optimized for E.coli
ccatgggtcagtctggcctgccggacgttaaacagcagggtgacgttagctacgttagtggtggcgtgggcctggacgaatcaaacgcgtttcagcgtgctgaacaccagtggccgctgagcattcgctttaccggtgcgggtggcgaatacctgagtggcgttcacgtgtctattatgtcacacgacggtgaagttctgaaagcagacacacgtggtccatacatgctggttcgtctggctccaggtgcttacaaagtgagcgcaaactacaacggcaaaaccgaaatgcgtaacgttacagtgccggccaaaggtgacgcaaaactggcctttagctgggcagcccagcaccaccaccaccaccactaataagaattc

SEQ ID NO: 4300 - DNA, 272 bp, Artificial Sequence
  Optimized for E.coli
ccatgggttctggctttctgtcatgggaaggtccgcagaacaccggccgtgcaaaagaactgacacgctgtggttgcagcaacattgacccgaactttcgtgcagcctaccgctttacctacacaggccagaccgcggctatgtacaaccagccggactgtgcgggtaccagccactacacatttcgtggcaacagcgaaagtgttcagccgtttggttggcgctctatttttattcactgccaccaccaccaccaccactaataagaattc

SEQ ID NO: 4301 - DNA, 605 bp, Artificial Sequence
  Optimized for E.coli
ccatggctagcctgcacaccgcaaaagaaggtgacacctttttcctgctggcccagcgttacggcgtttctgtggacgaactgaccaaagccaacccgaacattgcgtcaaacaacatttacgcgggtctgcagattaaagttccgggcgaaaaatctgtgaaagcagccagcgacagtaaaccgcagctgctgacagaaaaagccccggcgaacgaaggtccgaccattgaagcttggggcaaaacattcaactactcaaaaatcgttgacgtgaaagcttctgcatactcagcggctgcagacgaaaacggtaaatggggcgctgttgactactacggtaacccgctgaaactgggcaccattgcagttgacccgaacgtgattccgatgggtaccaaagttctggtgacgggttacagccacccaggcctgccagaccacagttttgtggctgtggctcgtgaccagggttctgctattacaggcaaacgcattgacatttttattccgggtaacaaaagttttgtgaacgactttggctttcagaacgttaaactgtacgtgattgacaaacaccaccaccaccaccactaataagaattc

SEQ ID NO: 4302 - DNA, 680 bp, Artificial Sequence
  Optimized for E.coli
ccatgggcctggcgaccgaaccggacctgcgtgttgtgacatgggaccgtggtccagacccggcagctgacgctcaggttagcaccggtgaaagttgtgctgtggaagctcagccactgctgccgggtcaggacccaggtgcactgccgccggcaccggaagtttgctttggctctctggaagaagcactggaatttgtttcaggtggcgacgtggcatcttctcgtctggctgacgtgacagctgctgaagttgaaggtctggtgtctgacctgaacgcgtcagcttcatctgcagctgctggtcagcgtctggctggtacagaacgcgctaccacagctgcagccagcagtctggttctgggcgtgctgtggcgtgacgcaaactacaaaggtaccagcaaagttctgtacggtagtggcacaaacggttgttacaccggcagcacatacggttttccgaacctggcaaacctgctgatgaacaacgttgtgaccagcgcgaccacatacgctggctgctgggttacactgtacgacagttacggttacgcaggcgcaaagaaaaactgtaccccgcactgcgcaaccctgggtacatttgacaacaaagcctcttcagttgtgtaccgtccggtgggtcagctgggccaccaccaccaccaccactaataagaattc

SEQ ID NO: 4303 - DNA, 1808 bp, Artificial Sequence
  Optimized for E.coli
ccatggccagcacccgtcagatggaaaaactgaaccgcggcgcagttgccgtgaaagttccggaaggtgtgctggttagctggcgcctgctgggtacagaagctgacagtgttggctttaacctgtaccgcggtacatctaaagtgaacgacgccccgattacatcacgtaccaactttctggacaaagcgggtaccacaagcagttcttacaccgttcgtgcggttgttaacggtgctgaacaggcagcaagcccagctgtgaaagtttggaacaacaactacctggacgtgccgattcagcagccagcaggtggcaccacaccggacaacgttaactacacataccacgcgaacgacgctagcgtgggtgacctggacggtgacggcgaatacgaaattgttctgaaatgggacccgagtaacgctaaagacaacagccagagtggctacaccggtaacgtgtttctggacggctacgaactggacggtacacgtaaatggcgcattgacctgggccgtaacattcgcgcgggtgctcactacacccagtttctggtttacgactttgacggtgacggcaaagcggaaattgtgtgtaaaacagctgacggtaccgtggacggtgcaggcgttaaaattggtgacgcatctgctgaccaccgtaacaccagtggctacattctgaaaggtccggaatttctgacagtttttagcggcgacaccggtaaagcgctgagtacaattgactacgttccgccgcgtggtacagtgagcaactggggcgacaactacggtaaccgtgttgaccgctttctggcaggcgtggcatacctggacggtgtgcgcccgagtattgttatggctcgtggttactacacccgcacagtgctggttgcatacgactggcgtaacggcaacctgtctcgtcgctggacctttgactcaaactcaagcacaaacgcgggtaccgctggtcagggcaaccactctctgtcagtggccgacgttgacggcgacgacaaagacgaaattgtttacggctctctggttgtggacgacaacggtgcaaaactggccaacaccggtatgggccacggtgacgctctgcacgtgggcgacctggacccagaccgttcaggttacgaagtgtttaaagttaacgaagacaaaaacgcaacctacggtgcggctatgtacgacccgcgtaacggcaacattctgtggggcgttaacaccggtaaagacaccggccgtggcatgtctgcggacattgacccgcgcaccaagggtaacgaacagtgggcaccaggtattggtctgcgttcagcgaaaggccagctgattaccaacacactgccgagttctattaactttggcatttggtgggacggtgacctgctgcgtgaactgctggaccacacatcaagcagtgctggtaaaattgacaaatggaactacatgaacagcaccacaagtaacctgctgaccgccacaggtacctcttcaaacaacggcacaaaaggtaccccgagcctgcaggctgacctgtttggtgactggcgtgaagaagtgatttggcgcaaatctgacaactcagcactgcgtatttacaccacaccgtacgaatctgaacaccgcttttacaccctgatgcacgacccggtgtaccgtctgtcagttgcatggcagaacgttgcatacaaccagccgccgcacaccggtttttacctgggcgagggtatgagtaaaccgcagcagccgaacatttacacaccgcaccaccaccaccaccactaataagaattc

SEQ ID NO: 4304 - DNA, 1007 bp, Artificial Sequence
  Optimized for E.coli
ccatgggttgtgacgaagaaggcgttaacgtgtctctgctggaccaggccgaccgcgaaattcaggcgaaatttccgaaaatgcactcatttctgctgctgcgccacggtaaactgatttgggaacgttactacaacggccacgaagttagcagtctgaacgacctgcgcagcgctaccaaatcttttacctcaacactgattggtattgcaatggcccgtggtgacatgccaggtccagaaacagcggtgcacaaactgctgccggaatacctgccgcgtcgcaaagaaaccctgctggaacagattacaattcgtcacctgctgaccatgacaagcggcctgtactggcagaccggtaaaaaactgggcgaagcctttattcaccgttttcaccgcagcaaaagttggccgagttttgcgctgcgcctgccggttcaggaagaccagctgggtgtttttcagtaccgtagcgtggacagtcacctgctgtctgtgctgctgacccactgttgcggcattgacgcttacacatacgcactgcagtacctgtttgaaccgctgggttttggccgctcaggttgggctcaggacccggaaggctacacaatgggtcacattggcctgtacctgacaagccgtgacatggcaaaatttggtgactgttgcctgcaccagggtagttggaacggcaccgaactgattccggctgactggctgcaccaggcaacacagcgccaggttgaaggttacccggaatttggtgactacggctttcagtggtggaccggtcgtctgcacggcattaactacgcttgtgctcacggccacggtggccagcagatttacctggttccggaagcaaacgccgttgcggtgtttaccgccgactctaaagtgtcacgttggaaaaacccgcgcacactgctggaacgttacgttctgccggcggtgtcttcactgaacctggaacgcagccaccaccaccaccaccactaataagaattc

SEQ ID NO: 4305 - DNA, 140 bp, Artificial Sequence
  Optimized for E.coli
ccatgggtggcattccgggtcagccagacccagacaccccgcagccggcagaaccgacagaaccaggtgaaccaacactgccagacgaaccgccgccggcaccggttgcccaccaccaccaccaccactaataagaattc

SEQ ID NO: 4306 - DNA, 290 bp, Artificial Sequence
  Optimized for E.coli
ccatgggtattgaccacattccgtgtcgtgacggcgaaaactttctgaaaatttggagtcacctgggtggcagcagttctgttgactgctacgcaaacaaaggtcgtattagctttggtggttggtggattgaccgcatttacaccggtaacaacgacctgatttactacgactcaaacggcagcgacgtgcgtattaaccgctggacagacattagctttccgaaccgtccgccgaaagttcgcgtgattgaaattctgcaccaccaccaccaccactaataagaattc

SEQ ID NO: 4307 - DNA, 368 bp, Artificial Sequence
  Optimized for E.coli
ccatggcaattggtcactacgaactgaagaaagcaaaaaacggccagtaccactttaacctgaaagcatcaaacggtgaaattattctgggcagcgaaatgtacgcgagcaaagcgagtgctgaaaacggtattgcttctgttcagaccaactcaccgcaggaagcacagtacgaactgaaacactctacatcaaaccagccgtactttgtgctgaaagccaaaaaccaccaggttattggcgtgagtgaaatgtacagcagtgaaaccgcagccaaaaacggtattcagagcgttattaaaaacggcccgagtacagacgtgcgtgacctgtctgcgcaccaccaccaccaccactaataagaattc

SEQ ID NO: 4308 - DNA, 1010 bp, Artificial Sequence
  Optimized for E.coli
ccatgggccaggccccgattagcagtgttggtggcaacggttctgcgaactcaggtggcggtctgatttctcagccgccgccgattgtttctggtagtggtcgtgcagcaccagctgcttctggcggtcgctcagaaaacgttgtgacccagaacggccgtattatttacaaccgcagttacggtaacattccgaaaggctcttactcaggtgaaacatacaccgttaaacgtggcgacacactgttttacattgcgtggattaccggtaacgactttcgtgacctggccgaacgcaacaacgtgagcgcgccgtacagtctgaacgttggccagcagctgcaggtgagcaacggtagtggcggtacactgaccggcggtaacgctattacagctgctgacgctacagctggcggtgttccaacccagccgaccacagctcagatgaaaagcaccacagttgcacgccagccggtgattacatactctgaagactcaggcaaaccgtctgaaggtaaaatgctgccgtcagccggtacaaacaccgttgctacaaccacagcaccggttagcgctccaacagtgtcttcaacaaccaacagcagtaccccggtgggtagttggcgttggccaacagacggtaaaattattgacaactttagcgctagtgaaggcggtaacaaaggtattgacattgcaggctctcgcggtcagccggttgtgagcaccgccagtggccgtgttgtgtacgcgggtaacgctctgcgcggctacggtaacctgattattattaaacacaacgacgactacctgtcagcatacgcccacaacgacaccatgctggttcgtgaacagcaggaagtgaaagctggccagaaaattgcaacaatgggctctacaggtacctcttcagttcgtctgcactttgaaattcgctacaagggtaaatcagtgaacccgctgcgttacctgccgcagcgccaccaccaccaccaccactaataagaattc

SEQ ID NO: 4309 - DNA, 977 bp, Artificial Sequence
  Optimized for E.coli
ccatgggctcttgtctggacggtaaccgcatgacaggcgttaacctgtcaggtgctgaatttgcagccgacaaactgccgggcaccatttttaaagactacgtgtacccggacccggcagacatgcgtcactttcagagcctgggcatgaacacatttcgcctgccgtttctgtgggaacgtattcagccacagctgctgggtccactggacgaagctgaagttcaccgcattgaagaaaccgtggcggctgcacgtagcctgggtacatgcgttattctggacgtgcacaactacggtgaataccgcggcaaaccgattggttctaccgaagttccgcgtgctgctctggcagacctgtggacacgcctgctggcgcgttttaaagacccggaaaacaccgcgtttggcctgatgaacgaaccgtctaaactgccggttgccgaatgggctgcagtggcgcaggaaacactgaacattctgcgtaagaaaggtagccgtcacctgattctggttccgggtggcagctggagtggcgctcactcttggtttgcaaaagacaacggtgtgtcaaacgctgacgcatttcgtcgctttcacgacccggccgacaactacatgattgaagttcaccagtacgccgacgcggacttttctggcacctcaaacacatgtgttgacccggcgcgcctgggtgctattatggcagacattgccgtgtgggcgaactctacccgtcgccgtctgtttctgggtgaatttggcgtgccggctaaccagcagtgcctgcaggcactggccgcgattatggacggtatgaaaggcaacagcgcctggggtggctggacctactggacaagtggcaaatggctgggtaactacccgtttagcctgcagccggacagtaacggcgacaaaccgcagatgaccattctgaaaacaggtatgcaccaccaccaccaccactaataagaattc

SEQ ID NO: 4310 - DNA, 515 bp, Artificial Sequence
  Optimized for E.coli
ccatgggtacatacaaactggtgaacagcggcccggaatacgcacaggttctggccgtgcagccggttaaacagcagattaaaaccccgcgtgaagtgtgtaaagacgttacagtgacccgccaggcgccggttaaagaccagcaccagattgctggtacggtggtgggtgcactggccggtggcctgctgggtaaccagattggtggcggtacaggtaagaaaattgctacagttgctggtgctgttggcggtggctacgctggtaacaaagtgcaggaaggcatgcaggaacgtgacacctacaccacaacccagacacgctgcaacaccgttaacgacattagcgaaaaagttgtgggctacgacgtgaaatacgaactgaacggtaaacagggtcaggttcgtatggaccgcgacccgggtagtcagattccggttaacaaagaaggtcaactgattctgggccagaaccagccggcccagcaccaccaccaccaccactaataagaattc

SEQ ID NO: 4311 - DNA, 734 bp, Artificial Sequence
  Optimized for E.coli
ccatggcagccctggttggtggctgtaccatgacaccgtggacagactcatggcagccaaccagcacaccgcagccaagtcgtcagaaccagggtggcgttctggccggttactaccgtgtgaacccgggtgacaccctgccatctattgctgctggttttggccagcgttctcaggacgttgcatcatggaaccacattgccccgacagacatgctgaccccgggtcaggttctgcgtgtggcaccgccgccgggtaacacagctattacctcaccggtgccgagcagtggtcagccgtcttcatctgcactgccgggtgcaacagcagctgaaccgccggcactggcctggccggcgcagggtaccgttacaagccgttttattccgggtaaaacacgcggcattaccattacaagtaccggtgacaaaacagtgcgtgctgctgcagctggtcgtgttgtgtacgctggtacaggcgttgctaaatacggtccgctggtgattctgaaacacgaaagcggcctgattaccgcttacggtcacaacggcaaactgctggttaacgacggtgacgcagtggctgctggtcaggcgattgctgaaatggccaccgacccggacggtcgtagttcttttgactttgaagttcgccaggacggtaaaccggtggacccgattggctttctgccgcgtaacggtggccaccaccaccaccaccactaataagaattc

SEQ ID NO: 4312 - DNA, 401 bp, Artificial Sequence
  Optimized for E.coli
ccatggacaacaaagcatacgttagccagacctacccgcgcctgacagtgtacaacgaagaaaactttcgtggtagccgtcgcgtttttcgcggtaacctgggcattcgtaacaccgacaacattctggacggcattgaatctctgcgtttctttagcaccagcagtaacgcaacactggttctgtttaccggtacacgttttcgcggcaactttcgtgtgtttcgcggtaaccgtaacattgccgacctggacgacctgattcgcggcaacgacgtggaaagcattattagtaccaaccagcgtctgacactgcagcagattcgcaacattcgttcttcaggtcgcctgccgagtggctaccgtattattcaccaccaccaccaccactaataagaattc

SEQ ID NO: 4313 - DNA, 1907 bp, Artificial Sequence
  Optimized for E.coli
ccatgggtaactctatgcagtggagcagtattcgtgacggctcactgtacctgcgtacagcccagccggaccgcctgaaaattggctggagcccggcttggcagagtgacgcaaaccgtgaacagctgtacctgctgcagccggacggtcagctgtttaaacagctggaaattcgtgccgaccaggcgtacggtgaacaggacattgaactgccagcagctgctggtgactaccgtctgcagattccgggttactcttttcgtggctttaccgttagccaccgcggcagtacagctgcacagtttgaaccgaccaaagttcacttttctgctgaagtgcactcaggtgcagaactgtactttcgcgttgccgcgggtgaacaggctattctggcaggcaaatactacggtggcgtttcagtgctgcaggcctctcgtctgtcagacggtgcgaaagtgcgcctggaactgaaagaacacccggcatacggccagtttgaccaggttgctctgccgccggcagaacaggacgaagtgtggcgtctgtctctgggtggctcaggcaaagctgcattttggctggacggcacagccaacctgtttgcgcaggaagtgcagcagctgcactctctggaccagccgcgtggtgaagcccacctgcagctgaaagcgcagattctgggtaccacaccgcgcctgggcattgcactgccgtacgcacagccgccgcagagcacctttggtctgctgcaggcaattggtgctcgtgctgctaacttttacagttttgttgacgtgattgaacaggaaccggaacgtgaaattggttttcgtcgcctgtaccgtgaacgctttggcattgaccgcgacattacactgctggctggcacaggtcgtcgcgcagttctggctgcagacgcacagagctttgcgggtctggacgcttggctggcagacagtgtgcgtctggccggtaacggcctgcactacctggcatttgccgacgaaccgaacctgaactacccggactactcttcatacgctctgtactttgaacagatgctggcgcgcgctaaagcaaacccagaagctcgtgctgcgggcgttcgtattgcaatgccggctagcagtcgtctgctggacggtccgtttcgcattggtgctggccagcgtcgcggcattgactgggcacgtcagctgctggaacgccacggtgaagacattgacgccctggcgtggcacgaatggatggtgcgtgacctgctggcaacacgtcgctaccgtgacagcgttcgcgctgcagctgaactggtgggtctggacgctgctggccgtccgcgcaaagccctgctgctgtctcagacaaacatttcttcaggtcgcgacctgtcaccgtaccagcaggacacacactacgctggcctgtggtgggcgagcgttgtgattaacgctagtgcagacggtctgctggacatgctgaactggtttcaggcagccgacgaaccggactacccgaaaggcatgctggctcagcgtagcgcaagtcagtttagcctgaaaccggttgccgtggcgcagcagtttattgctcgtcactggctggcacacgttcaggctctggacaacccagcctttgaagtggacgctctggcaatgtctgaagctggccgccactcactgctgggcgttaacaaagctagccgcgttcaggcagtgagtctggacggtccaggcgacctgtgtcaggctgctccgctgaaactgtctctgctgggtccagacgaccagccacgtgacgcaaccgttgaatgccgtgacggtcgcgtgcactttgaactgccgggcgaaaccctgtttgccctgacatggaaagcgctgcaccaccaccaccaccactaataagaattc

SEQ ID NO: 4314 - DNA, 416 bp, Artificial Sequence
  Optimized for E.coli
ccatgggtcagacagactctgctctgccgccggttcagaaaagcggtgctgtggaatacctgagtggtggcattggcctggacgaaagtacagctattcagtctgcatcaccgcactggccgctgtctctggtttttagcgtgcaggcagccggtaaagcggaatttgcttctgacgttaaactggaaattcgtgacgctaaaggtggcgtggcactggaaaccacagcctcaggtccgtttctgctggcaaaactgccgccgggcagctacagtctgcacgcaaccctggccggtaaagcgctggaacgtaaagttcaggtgaaagccggcagctctgctcgtgttgaactggtgtggccagctggtacaaaccagggtcgtccgcaccaccaccaccaccactaataagaattc

SEQ ID NO: 4315 - DNA, 1607 bp, Artificial Sequence
  Optimized for E.coli
ccatggcaaacctgagtgacattcaggtgtctaacggcaacgaccgtgcctcaattacactgagctttggtggccagccggtttacggtttctttccgctgcacaacccggaacgtgttgtgctggacattcgccagtcaggcgtgattaaaggtctgccgctgacctttagcggcgacaacatggttaaacgtattcgcgcatcaacaccgaaagacaaacagagcattcgtctggtgtttgaactgacccagccgggcaaaacccgtgccgttacacagcgcaacggttcaacctacaacgttgtgtttaccattaacggtacacgtccggcaccgcgtagtgcagccgtgagcagtgtttctcgcccggtgccggctgacaacccgtttaagggtaacgcagtgacagccgttagcaacggcaacgaagtggctgtgccaggtcgtacagtgcgtgctgttgacgaagctattattgttgcgattgacgctggtcacggtggccaggacccaggtgcaattggtgccaacggtctgaaagagaaaaacgtgacaattgcgattgctcgtaaactgaaagcactgctgaacgccgacccgatgtttaaaggcgttatgacccgcgacggtgactactttatttcagtgatgggccgtagcgacgttgcgcgcaaacagaacgctaacctgctggttagtgtgcacgctgacgctgctccaaaccgttctgctagtggtgctagtgtttgggtgctgtctaaccgtcgcgcaaacagtgaaatggccggctggctggaacagcacgaaaaacagtctgaactgctgggtggcgcaggtgacctgctggcgaactcacaggctgacccgtacctgagccaggccgtgctggacctgcagtttggccactctcagcgtgttggttacgacgttgcggtgaaagttattgctcagctgcagcgcgttggcagtctgcacaaacgtcgcccggaacacgcatctctgggtgtgctgcgttcaccggacattccgagcctgctggttgaaacaggctttattagtaacccgtctgaagaacgcctgctgggttcttcagcataccagcagaaaattgccgaaagcatttacaaaggtctgcgtaactactttctggcgcacccgctgcagagtattccgaaagaagaaaaccgtccactgcagtctgcaacagctgtggacgttcagccaaacccggctccggtgagtacccgttacgctggcgctgttacacgtcacgttgtgaaacgcggcgaaacactgtctggtattgcggaccactacggtgtgagtatggctatgctgcgttctatgaacaccctgaagaaagacgttgtgtgggtgggccagcgcctgaaagttccggcaagcggtgcccagtctgtttcagcgagccgtccgcagcgccacaaagttgtgcgcggcgactcactgacagctattgcagcccactacggtgtgagcccgaaagcaattcagcaggccaacaacatgaaatcacagaacgttatgctgggtcagaccctgacaattccgaccagccaccaccaccaccaccactaataagaattc

SEQ ID NO: 4316 - DNA, 3245 bp, Artificial Sequence
  Optimized for E.coli
ccatgggtcaggaaatgcaggaagttgcaccgtcagtgagcaccagtgactctgaagttggtacatcagaaagccgtagtgacgttagtggcgaaatgaccgaaaccacaaccaacgcgagcagtgaacaggctagtcagggtgaagaaaccatgatgaactctgaactggtttctgcctcaacagacatgtcactgtttttcgacaagaaaattcgtctgcgcagcgtgcgcagcgaaagtgcatacctgacctgggacggtaacggccagtttctgatggacgccctgcagtcaacaatgaaccagagctttctgattaacggcacagttgaagacggttacaccattcagaacagcgaaacaagtgcgaacctgcacgtgctgagcaaagaagcatttgcccagcgtgaagaaaaaatcgaacagaaatggtttttcgaactgctggaaaacggtagttacacagttcagaccgctgacggcctgtacctgtcttcaaacgacaaaaacgaactgattctgtctgcggacgctgaagacgaagcagcccgctggcaggttgaagtgattgaagaaccgcagaaactgccgatggaagcgccgctgaccaaaattccgctgtctgaaatttcaattgctaacggcacataccagattcagagcagtggtctgtcaatgtttctgagcattggcgaactggacaaaaccctgcgtaaacagctggttgtgtcttcagaaggttactcactgagcagtaaatttcagattacacgccagaccgacggctggtacacaattaaaaacaaatacagcctgctggcggctgacattgcgggtggcattggtaaaccgcaggttgctgtgcagcagtaccaggacaaccagtcagcagcccagcgttttcgctttctggacgcgggtaacggcgacgttgtgattgaaagcaaactgggcacagttattgaacgtaccggtggccagagcaacgaaagtaccccggtgcagacatacacctttaacaactcagcggctcagaaatggcgcgttgtgagcgaaacagttgcaaacgaagtgaacattgccgacggtatttacaacattgcaggtagtggcattaacaaaaacctgtctctggccaacaaatctaaatcagaccgtattggcattgttctggaccgcaacgttagtgaccaggtgcagcagcagtttgacattaagaaagaagcagacggttggtacacaattaccaacaactttagcaagaaagttctggacatttctggtggctcagcaggcagccgtgttgccgtgcagcagtactttgcgaacaaaagcgacagtcagaaattcaaattcatcgacggtggcgctggtaacgtttttattctgagtaaactgggtacagtgctggaccgtacaggtggcaaaaccgacaacggtacagcgattcagacctaccgtctgaacaaaaccatttctcagctgtggcgcctgagtgctccgcagtctccgaaaacagttgacattaaagacggcgaataccagattaagggtaactcaacaacccgtgtttttagcattggtgacctgacaacagcagacgctgtgctgctgcgtctgcgtgacagtacctactctaaaatcgacaacttcgttatcaacaaacaggtggacggctggtaccagatcaaaaacaaattcagtaacaaagtgctggacattcagtctggctcttcaaaaaacggtgttcaggttcaacagtactttgcgaacaacagtgaagctcagaaatttcgttttattgacgccggtaacggcgaagtttacattcagtcaatgctgggtagcgtgctggaacgcccgggtggcggtacctctgaaggcctggcaattaaaacaaacgacctgaccaacagtgcagcccagaaatggaaaattgaaaaacaggcctctccgaacctggttaaaccggtgaacggtcagcgttacctgctggaagcgggcaacaacaccaacgctgttctggacattaacggcggttctaccgcaaacggtgcggttgctcacatttggacagaagcagtggccccgcagcagaaatttattccgcgtgacctgggtaacggctggtaccgcctggaaaacgaaaaatctaagaaagttctggacgtggccggcggtagcagttctgcaaaagtggctgtgcagcagtacgcatggaacggtagcgacgcccagcagtttcgctttgttgacgcgggcggtggctacgtttacgtgcagagtaaactgggttcttacctggacatggtgggtggcgcttcaagcaacggcacacgtattcagacctactcactgaacaaaagcgcggctcagaaatttaaactgcagaacattagcaaagcgaacgctctgcgcacaaccgttacaaccaacaaccaggcgaaaattaccgtgtacaacccgaacggtggcaaagttgactcagtgcgttttccgacatggagccgcgaaaagggtcaggacgacatcaaatggctgatcggtaagaaaaacatcgacggttcatggaccgctgaagttaacgcagccgaatttaaaaacggtggcacatttgacacccacgtttacgtgaaaagtggtggcaaagaatctggtgtgggcacaaccagctacaaactggacaaaccggcaccgccggctccgccgaaaccaaccgcaccgccgtactactacagtcagtgggacggtcgttggtctggcctgacatacggttactaccgctttggtccgacaggctgtgttccgaccagcatggcaatggttctgcgtggtagctacggcgttaacgtgacaccggttgacaccgcaaaccgtattcgctcatacggtggctttaacgtgcagtacatgggtgccagttctaccgacctggttcgtggcatgaacagttacggtcgctctgtgtacgcggctaaaagcgaagcagacctgacagaccacctggttcagggctacccggtgattatgtacgttaacgtgggtattggccacgcaattgttgcccacggctactcaaacggtaaaacctacattagcgacccgtacaacaaccagttttacagtggttgggtttctatttcacacctgtggtctgtgccgacaaaagacccgcaggactggaactacggctacccgtactttattattaaacaccaccaccaccaccactaataagaattc

SEQ ID NO: 4317 - DNA, 1064 bp, Artificial Sequence
  Optimized for E.coli
ccatgggtctggcagcctgtgccacccaggaaccgaccacatctggtacccagaacgcggcttcaacaggcaaaccgattctggcaccgaaaccagcagcaccagcagttacaccgcagcaggccgaactgaaatctctggttgccctgcaggaccgtctgtacgacgtggcggctccgctgctggttaacaacgcagtgctgtgccgtaacaacgcccgcaacctgctgggctttaccgcgaaaacaaaattctcttacaccgctgaatttatcgacgcagccacctcactgggtctgacagaccagctgcaggttaccggcgtgctgacaggttcaggcgcggctaaagttggtctgcagcgtggcgacctgctggttgcgattcaggacaaaccagtgccaacaggtgctgacgcagaacgtcagacagctctgatgctgggtccgctggttaacggccgtagcaacattaaagtgaccattgcgcgcaacggcagtaaccagaccctgaacgtgccgctgacacgtgcctgtgcgtttggtattgaactgggcaacacagacaacgttattagctacgcagacggtcgtcgcgtgctgattagcgccggcatgatgaaatttgttcgcagtgacgacgaactggcctacgtgattgcgaaagaaatggctcacaacaccctgacccacccagctcgtcagcgtctgaccgctacactgtctggtgttattgacaacctggtgcgtctgcgcccggacaacgcgccgctgtcaggtgcagccggcgttaaaccatacccgcagcagctggacgctgctgcagacaaactggctctgtacatggttgctcgtgcaggttacaaagtggacgacgcatctgctttttggcagcgtctggctacccagtacccagctacagtgctgaacggctacaccgcaattcacccggccaccacataccgcattgccgcgattgaacaggcagttagtgacattcaggctaaacaggcaagcggcagtaccgtgctgccgcaccaccaccaccaccactaataagaattc

SEQ ID NO: 4318 - DNA, 2213 bp, Artificial Sequence
  Optimized for E.coli
ccatggcaattgttctggaaaacccgctgtggcacattgtgctggacccgggtaccctggcgattcgtgttacaccggctggtgcagctgctgttcaggtgtctgacggtgttggttcacaccgcgtggctgcactgcagagtacagcagaccaggctggttggcagtgggacgacggtgcgtaccgtattgaagctaaactgtctgaacgtgacctgatgctgacagtgcgtgcaaacgctgctggtgccctgacactgattcgccagccgggttcagcaattggtcgcggtctgattctgccgctggcagaaggtcactacgttgcccgtgacaacaaagtgtggaacgactttattctgcagaaaatgggccgcctgaacaccacacaggacctgtctctgccgctgtggggtatggaccacggcaaattttcactgcactggctgctgaccaacccgtacaacaaccagctggacttttctgcagacggtagtggtctggctctgcaggctagccacacctttacacagctggccccggacacaccgatgaccctgacactgcacctgggtgacggtgacctgctggctggtgcaaaacactaccgtgcgtggctgctggctgaaggccgctttgaatctctggcagaaaaaaccgccaaatcaccgggtgctgcaaaactgattggcgcatctcacgcctacctgtggggctcaggtctgattgccgcgaaagacgttcgtagctggccggcgtttctgcgcattctgcgtagtaaaaacccgctggcaattgacctgcgtcgccactttgccccggaatcacgtaaagccctggcggaagctggtaccaacccggcacgctaccaggaaaaaattctggtgggtgcgtttaacgctggcctgaacagcctggcacgtgaagcctggcagacagacgctccagacgttaaccgtctggctagccgttacggtgaactgcgcagtgaagtggcacgtgcctttggcgctgcactgaacgcggacgctaaagactggggtggcggtgtttcaggtgccacaatggaacagctgcgcaaagctggcctggctcgtctgtggctgggcctgggtgaaggttgggaaggcggtctgtggcacccggaagcgattgccgcgggtgtgaaagcgggctacctgctggctccgtacgacagctacgaaacagctctgccgcgtggtcacaacccggactgggcaaccgcccactttggcgaaaaaacataccgtgactgtgcgattgttctggacgacggtcgctttaaaaccggctttaacggttttggccactacacaaacccgttttgcatgcgcccgctgatggaagctcgtgttcgtgctgtgcaggaaaaagccggttttaacagttggtttctggacgtgaccgctgcaggcatgctgtttgacgactaccgtcgccgtgccgcgatgacaatggcacagaacgcgtacgctaacgctgcaagcacacgctggattagtgaagaccgtcagctgccggcgggttctgaagacggcaacgcagttaccgcccagggtattttctttgctcacggcatgcagacaccggtgattggttggggcgacaaagaaatgcagaaagacaaaaaatctccgtactacctgggtaactactacccgccggaagaaccgagtaacatgtttaaagcagttccgctgaaagccctgtaccgttctattcactttgacccagctgctcgtctgccactgtaccaggcagtttttcacgacagtgtgattaccacacaccactggctgtttgacaacctgaaactgaccaacgttcgccgtgaaaacgaactggcccagctgctgtacaacgtgccgccgctgtttcacctgagcgaaggtacactggcaagtcgcctgccgctgatgcagcgtcaggacgcatttttccgcccgctgcacgaaaaactggcgaaccaggctctgaccggctttcgttggctgtcagctgaccgtctgctgcagcagaccggttttgctgacggcacaatgcaggttgcaaacttttctgccgaagaacgttcattcaacggtcgccgttttccgccgtactcagtgaccgcactgacagccgacggtaaaaccacagtttttgtgagcgaagacggccgccaccaccaccaccaccactaataagaattc

SEQ ID NO: 4319 - DNA, 1217 bp, Artificial Sequence
  Optimized for E.coli
ccatgggtcgtgcgggcattctgtgtcgcgaatttgctattggtttcggcccgaaaatttttagtttcaagaaaaacgaaaccgtgtacacaattcgtctgctgccggttggtggctttgtgcgcatggcgggcgaagacccggaaatgattgaagttaaaccgggttacaccgtgggcctgctgtttaacaaagaagacgaagttgaaaaagtgatcatcaaccagaaagaaaaatacccggacgcactgattattgaagttgaaaccgccgacctggaacacgaaatgaaaattacaggttacgaacagggcaaagaagacgaactggcgggttttaccgtgagccagaccagctttttcattgttgacggcgaagaagtgcagattgctccgtacaaccgtcagtttggtagtaaaccggtttggaaacgcattaaagcaattgcagccggcccgattatgaactttattctggcctacgttattctggtgatgctgggttttattcagggcgtgccgtctaaccagccggaactgggtaaactgaccgacaacggtcgtgctgctgcagcaggtctgaaagaaggcgactacattcagagcattaacggtgaaaaaatgcgcagttggaccgacattgttacagcggtgaaagaaaacccgggtaagaaaattgacgttgctgtgaaacgtgacggcaaatcttttcacatttcagttaccccggaagccgtgaaagacgaaaacaagaaaaccattggtcgctttggctcatacgcaccgacagaaaaaggtgccctggcggctattgcgtacggcgctacctctacagttgacgtgaccaaagcaattctgacaaacctgtcaaaactggttacaggccagtttaaactggacatgctgagcggtccggttggcatttacgacatgaccgaccaggtggccaaaacaggcattattaacctgtttcagtttgcagcctttctgagcattaacctgggtattgtgaacctgctgccaattccagcactggacggtggccgtctgctgtttctgtttattgaagccattcgtggcaaaccgattaaccgcgacaaagaagcgtttgttgtgtttattggtgttgcttttctgatgctgctgatgctggttgtgacctggaacgacattcagcgcctgtttctgcaccaccaccaccaccactaataagaattc

SEQ ID NO: 4320 - DNA, 1190 bp, Artificial Sequence
  Optimized for E.coli
ccatgggtaacaaagacgttctggtggacctggacattccgcaggcaggcaactacgcccagctgtacatgccgcaggctacctctaacccgattggtatgggcatttcaattacagaccaggactaccaggttccgtacgcagctcacctgggtggcagtctggctgctcagaccgacattagcgttacatttaaagtgagtccggaactggtgacccagtacaaccagaaaaacaacaccacataccagctgctgccggaaggtagttacgcgctgcagaccgaaaacgctatgattccgaaaggcgcacagggtaccggcattctgaaactggttatcaaaacaaaaggttttctgcaggcctttgaatcttacctgctgccggttagcgtgagtgctccaagcggcgttaccctgaacaaagaactgagtaccacatactttgtgattacaggttcttacgccccgggcgaagttccgcgtgaaaaagtgctgagcatgggtgcagacgccggcgactttctgattgactttaacggtgactttattcgcaaagcgccgctgaccggcgacctgattctgtacaaagctgacgcagccaccggccagtttacagcaccgccgaaaacaattggttttggctggaacgtgatggacaaaattctgtcatacggtggcaaccgtctgattgcccgctttggttcaggcgcgggtgacattaaccagtactttctgagccaggacggtgcgtttggtgctcagcgtggcgttggtcagggttggggtggcctgtctgctattgtgccgtttaaaggtctgctgctgggcattgcggctaacggtgacatgaccaaatttccgctgaacggtgacggcgactttgactacggtaacattaaacagattggtacaggctgggcaggcctggcccagatttttagctaccagaactcactgattaccattgaaaacagcggcgacatgtggcagtacccgctgacagacgacggtgtttttggcgctcgtaagaaaattggtaccggctgggacatgtacacaaaagtgattaccgcaggtacagacctgctggctctggacgctaacggcgacctgtggcgctacaaatttaacccggacggtctgtggccgctgaaaaaacaccaccaccaccaccactaataagaattc

SEQ ID NO: 4321 - DNA, 344 bp, Artificial Sequence
  Optimized for E.coli
ccatgggtcgtgacatgctgggcctgagcatggacatgggtggtaaaaaatctggtaacctggttcagaaagcgcgcaccaaaatgatggacgcagcctttccgggtatgggcgaaattaccctgaacaaagaagacacacacaaagaccaggaccaccactctccgaccgacaaaacagcgcacaacgctcacaccgcaaaaaacaaagaagaaaacatgaaactgatcaaagacttcatccgtacaagcccggacgttaaacgcgaagtggaacagattctgaaagaaacccacacagcagtgccgggcctgcaccaccaccaccaccactaataagaattc

SEQ ID NO: 4322 - DNA, 1940 bp, Artificial Sequence
  Optimized for E.coli
ccatgggtcaccaccaccaccaccactacgaccaggtttacgtgtttggtgacagcctgagtgacacaggcaacaacggtcgttttacctacgacggcaacaaacacctgctgtacgacgaagttctggccgaacgcattggtgctgccctggtggcgagtgacgacggtggctacaactacgctgcaggtggtggtgttgctgtgccagctctgaacccagctgacaacacccaggaccaggttcagtcttacctgggtcgtgttgacggtcgtgcagacggtgacggtctgtacattcactggattggcggtaacgacctggcagctgctgctctgaacccaaccacagctagtgacgttgcatacaactctgcagccgcggctgcagttcaagtgcgtagtctgctgaacgcgggcgctggtacagttattgtgccgaccgtgccgaacattggctctacaccgcagctgatggaactgattattcagcaggcactgaccccggttcagggtgcagctgtgcaggctgcatacgctacactgaacagtctgaccacaccggacaacgtttctcgcacacaggccattcaccaggctctgacctcagctgctgctcaggcatctgcaattccacaggtgcagcaggctattgcagcccagctgattgcggcttttgactctctgtcagcacaggcagcccagctgaccgacttttacaaccagagtgaagaccgcctgctggcacagggcggtggcaacgttgtgcgcgttgacgtgaacaaactgtttgcggaagctattgcaaacccggcgcagtttggttttgctaacacagctggtatggcatgtccagcgggtgttagcagtgcagtgtgctcttcagccacaccgggctttgacgccagccagagttacctgtttagtgaccactttcacccgtctccgcaggcgcacctgctgattgctgactacattcaggcactgctggacggtccggctcaggttgtggcactgaaccaggccacagctgctatggcccgtgactcacgtgctaccctggacagccgttttcagcagctgcgtaacggtgacaacccgcagggcagtctgggtgtttttggtggctacgctggtcagcactacgactactctgcaaacaaagcagccggcgacggtaacgcaaccacacacaacctgaccgttggcgtggactaccagctggccgaaggctggctgattggtgcgctgatttctggttcaaacgacgaccagcagccgagcagtcgttacgaatacaaagcccgcggcctgctgctgtcagcttttaccgcactggacctgtttgaacacggttgggttaacgctgacctgcactacgcaacaatggactacgacgacattcgtcgcagcatgcagctgggtccgctgacccgtacagaaaccggcagcaccagtggtaaacagtggggcgcgcgtctgacagctggttacgactttccgattacctcttacctgaccacaggtccgatggcccagtttgcgtgggactacagcaacgttagtggttactctgaagacggcaacaactctacatcaatgcgttttaacgaccagacctaccactcacagattggtgctctgggttggcgcctggacagccagtttggcctgtttaacccgtacgccgaagtttcataccagcaccagtttggtgacgacgtgtaccgtgcgggtggcggtctgaaatcaacacagaccagctttacccgcgacagcgctggccaggacaaaaactgggttgacgtgacactgggtgcaaacatgccgctgaccgaccaggttgcggcttttgcagccgtgtcacagacaggcggtctgtcttcaggcgaacagtttatgtacaacgttggtgtgagcgcacgtttttaataagaattc

SEQ ID NO: 4323 - DNA, 488 bp, Artificial Sequence
  Optimized for E.coli
ccatggcggaaccgaccctgtacggtcgttacgaatacattgcgctgccggaagttggtggccaggtgctgaaagctaaaatggacaccggtgcactgacagcctctctgtcagcaaaagacattgaaacctttacacgcgacggcgaagaatgggttcgttttcgcctggcgacaaaaaacgctagcaacaaagtgtacgaacacaaaatcgcacgtatcagcaaaatcaaaacccgcagtgaagaagacgaagaagacagcgaagttattgccccgacaaaacgtccggttgtggacctggaactgtgtctgggcaacgtgaaacgtaccgttgaagtgaacctgacagaccgcagcagttttaactacccgctgctgattggtgcgaaagctctgcgcgaatttggcgcagccgttaacccggcacgtcgctttaccgccgacaaaccggactgccaccaccaccaccaccactaataagaattc

SEQ ID NO: 4324 - DNA, 509 bp, Artificial Sequence
  Optimized for E.coli
ccatggcggacagcgccaaagcgagttacaaagcagccgaagacgcggctgacgctacctacaaagcagacaaagccaaatgtgacgaactgtctggtaacggcaaagacgtttgcctgaaacaggctaaagcaacccgtgaacacacaaaacaggacgccaaagcggaatacaaaaacacaccgaaagctgttgcaggtgcccgcaaatcagaagcggacgctgactacgcagtggccaaagaaaaatgtgacgcgctggctggcaacgcgaaagacgtttgcgtgaaacaggcaaaagccgaccagaccaacgcggttgctaacgcaaacacacagaaagacgtgagcaaagccaaagcggacgctcgtgaagaacgcgcagacgcccgttacaaagttgcgatggctaaatgtgacgcactggccggtgcagccaaagacgactgcgtggcggctgcaaaagcggacgctggcaaacaccaccaccaccaccactaataagaattc

SEQ ID NO: 4325 - DNA, 1838 bp, Artificial Sequence
  Optimized for E.coli
ccatggcgatttttgactacaagggtcaggacggccgtgtgctgattagtgacgcctggaacctggcgacctacacatctggtgttgctacagtgggcgcactgtacaacctgccgggtgccgtgctgggtgaaggcaacacctttgttctgccgaaaggctggcgcgaaatttctgcgtcagacctgggtattgacggcagtcacctggacctgacaggttcttttaaaggcgaaaacgtgagcggtagtcaggcaaaagtttttggccagtacgacgaatcaggcaaactggttaaaatgggttttagtattgctggcaccaactctccgatggacctgctgggttacccggcaatgattgacaactcatacattcacggctacgactacctgctggacagcattaaaaactacgccaccaaccacaacctgaccggtaaagacgttctggtgaccggctactctcagggtggctcagtgacaaacagcatgtacctgggtcgtgacaccctggcggacggtttctttaaagactcagactactttggtatggccagcccgaaagcgtctaactcagacggtatcttcaacttcggcttcgaaaacgacattgttcaccgcctgattggtgaacagacagacctgagcggcgccattctggcagccctgaaaggttcagacgcgaactacaccagcaccacagacaacattgttctgtttgacaccgtgtacgctctgccgacatggccgaacggtccgtttagtgttgtgaacccgaacggttgggtggcacacctggaaggcatttttattaacccgattcagcgtattggccagtctacattttacgactacattgaacgcgactcaaccattattattagcaacctggacccggtgagccgtagttttacatgggttagtgacaaatactctgctacctcaaaccactttggtacaccggcctttctgctgggcaccgactctgcggacaaactgcaggacggtcgcaacgacgactttctggacggttttgccggcaacgacagttttaaagtgtctaccggcacagacattgttgcgggtggcgtgggtgacgacaaagtttttctgcagggcacagtgagcagttacgaagccgttcgtctgagcgacggtagtctgtttctgaacgacaccggtggccgctacggcctgaaagaactgcacgacgttgaacacgtggaatttgaaggtctgctgggtcaggctctgaccccggcatacaccgttacatcttcaaaactgaactttgaaggtctgtttggctctgacaaatcatacgctaaagcaaccgaaggtacacagctggctgacctgctgaaaggtaccgcaggccgtgacctgatttttggccagggtggcgacgacctgattgaaggtggcgccggtcacgacctgctgcacggtggcagtggtaacgacacactgctgggtggcaacggtaacgacgcactgtacggtggcgcgcacaacgacattctggttggtggcctgggtaacgacaccctgagtggtggcgtgggctctgacctgtttgtttttgaccagggtggctttggtcacgacctgatttcagactttaacgtgcaccagaacggctttgaccagctggtttttagcaaatcactgtttgctagcgcggctgcagtgattagcgcaacaagtcagcagggtagcgacagtctgattgtggctggcgacagcagtattaccctggttggttttaacgccgcgcagctgtcagcagacatgattagcctggttcaccaccaccaccaccactaataagaattc

SEQ ID NO: 4326 - DNA, 1187 bp, Artificial Sequence
  Optimized for E.coli
ccatggaaccgcacccgcaggtgcagaacgacgctcagcagtaccagggtgacgcactgaaactgctggaacgtctggtgaacattgactctggttcaggctacgaagccggcctgaaccaggttagcgacattgcgattgctgaactgaaaaaactgggtgctagtattgaaaaagttccaaacggtgcagccggtggcaaccacgttctggcaaccctgaaaggtacaggcaaagctcgtattctgctgatggcacacatggacaccgtttttaaagaaggtacagcggctgaacgtccgtttcgcattcaggacggtcgtgcttacggtccgggcgttatggacgacaaaggtggcattgtggctggtatttacgcactgaaagttctggacaacctgaaatttaaagactacgcccagattacctttctgctggacgcgagcgaagaaaccggcagtgaaattgccacagacctgattaagaaaaccgcaaaagcccacgacgtgacactgaacctggaaccaggccgtccggctgacggtctggttgtgtggcgcaaaggtagcgcgacagctctggttgaagtgaagggtaaagcagctcacgccggtgttgctccggaactgggtcgtaacgctgctatggaagcagcccaccagattctgcagctgggtaaactgggcgacgaagcaaagaaaaccacaattaactttacagtgctgaaagcgggtgaccgtaccaacgttattccggaccaggcaacagctaaagctgacgttcgtgctgctgtgccagaagaatttgaccgtattgaaaaagacctggcccgcgtgagcgcgaacaaactgattgctgacaccgaagttaaaaccacgctgcagcgtggtctgccgccgatgccacagacagaacagagtgacgcactggtggctatggcacagggtatttacggcgaactgggtcgcaaactgaccattgaaggctctggtggcgcagccgacagcagtctgtctgccggtgtgggtaccccgacactggacggttttggcattgttggtggcaacattcacacaccggaagaatacgccgaagttgaatctgtggcgccgcgtatttacctgctggctcgcatgattatggaactgtcagcaaaacaccaccaccaccaccactaataagaattc

SEQ ID NO: 4327 - DNA, 1448 bp, Artificial Sequence
  Optimized for E.coli
ccatggttcagaacctgccgaccctgggtgacacatctcgcgaaagcctgagtccgctgatggaacgtaaactgggcgaagaagtgatgcacgacattcgtcgcgacccggactacctgaacgacgcgccgctgctggaatacctgaacaactttggttggaccctggttaacgctcgtccggaagtgcgcggtgaagcaggctttgactttttctttttcgccgttcgcgacccggtgctgaacgcatttgctctgccgggtggctttattggtgttcacagcggcctgctgctggcagcccagtctgaatcagaactggccagtgttctggcgcacgaaattggtcacgttgcccagcgtcacattgcgcgcatggttggcagccagaaacaggacagtatgattgctctggcatctatgctgctgggtgctctggctatgcgcggttcaggtgacgctggtgcggctgtgatgatgggtggcaccggcctggctatgcagcgtcagctgaacttttctcgtgacgctgaacgcgaagcagaccgtattggcctgagcattctggacagtggtggctttgacacctcaggcatggtggcatttttcggccgcatgcagacagcttctcgtaactactcagacgttgtgccgccgtacctgctgacacacccgctgaccacagaacgtattgccgacattgaagcgcgtattcgcgaacagcgttaccgccagcgtgcagacagcctggactttcagctgattcgtgcacgtgttcgtgtgctgcaggacgacaccgaacagggtcgtcgcgacgcccagattgtttttgacgcgcagctgcagctgaacacaaaacagcagattgtggcagccaaatacggtatggcttttctggcatttaaacagggcgcttacgacaaagcagaagacctgctgcagcaggctgttgctgctgcactgccagcgaaacagtctctggttctgaccgacctgggcgtggaaattatgctggcatcaaaacgcgaagctgaagcactgaaactggtgcagcagggtcagctgcagtacccgctgtctcgtggcctggcacaccagtacgcacgtgctctgattgctagtaaacgtctggacgacgcaattaaatacctgcgcgaacaggcacgtctgtaccgtcaggacgctgacgttcaggacctgctggctcaggcatacagcgctcagggtaaacgtgcactgcagcacatggccctggcggaatcttacgttctgacgggctcagtgccggctgctctggaccagctgcgtattgctcgcaacagcggtgacgcaggcttttacgaccagagtatgattgacgcccgtgaacgcgaactgcaggaacgctggaaagaagaactggctgcaagtaaagaacgtcaccaccaccaccaccactaataagaattc

SEQ ID NO: 4328 - DNA, 1454 bp, Artificial Sequence
  Optimized for E.coli
ccatggcgtctattggtgaacgtctgacatcaccggaagctggctggaaacgctttgacgacaaagacccgaacattatttacaaaggtgcctggcgtgacggtaacggcgacatttactacaacctgagccgtaaagtgaccaaccgcagtggtgacacagcgaccctgagctttttcggcgacaaaattcgcattattacagactctgctaccggccactcaaacaaactgaacattgaaattgacgacgttctggaatcatttccgctgaacaaaggtgcaggcagccagtacctgacatacgaaaaaattaacctggacaacacctggcacaaagttgtgattaccacaaccgactctctgttttcaaccattgacgccattgacattagcgaaaacggttttctgggcaacccgacagttattgaaaaaattaaagtgaccagcggtgaagcaagtgccgacctgaactggggccaggtggaactggcaacaagttacaaaattaaacgtagcacaaccagtaaaggtccgtacacaaccatttctaacaactcaaccggcctggaatttaacgactctaacctggcaaacgacacaacctactactacattgttgaagcctacgacaaaagtggtaaactgattcacacaaccaaagaatgttctgtgacaccgccgtacagcagtatggaaggcatgggtggcattagcccgccggttggtacaacagctaccgcttcttcagacgacaaaaacgcgattaaagctctggaccgtgactttgacagtcgctggaacgcagtgaccccgattgcctctctggaactgaaatttccgaaaccgctgcacctgaactttgttcagctggcagcccaggtgacaccgcagacccaggttgactacacaatttttggtctgaaagacggcgaatggacccagatttcaccgattacaacccgtgcgattgacgtgagcacccagatgcgtgttctggaccgcattaacattacagaaggtgtttacagcagtattaaaattaccgcaaacgcccgctcttcatgggcgagtattcacgaaattacactgggtattgtttctgcaattccggtgaccccggactctccgggtagtgaaacaccgaccccggaccagacaccgaacccggaaccatcacagccaacaggtgaccgtgctattctgagcgtgacactggacaccggcctggaaaaagaatttgacctgagcatgaaagaagttaacagttttattgcatggtacgaaggtaaacagagcggtagtggcgcggcttcatacgccattaacaaacacaacaacaacaaaggcccgtttagcaaccgcaaagactacgtgatcttcaacaaaatcctgacattcgaagtttctgaatactcaaccaaacaccaccaccaccaccactaataagaattc

SEQ ID NO: 4329 - DNA, 713 bp, Artificial Sequence
  Optimized for E.coli
ccatggcgagcaccagtggttctcacaaaagtaaccagcgtggtacagctacagtgccagctccggttgaaaaagacacctctgtgcaggctattgaagaagcagcctggaaaaaacacaaactgccgaaaacactggaagaagcaatgcagatgaaccgtgccagtgtgctgctgctgtcagttccggaaagcgacaccgaataccgcctggacaacgacaaaccgtcaattaccacagaagaccaggcggaacaggacagcctgctggactgttcaattacaagcattcacattgctgaaggtcgtccgcgcccgaaacagcgcgttgtgctgagcgaacaggacattgaccaggcatttgacaccgccaaagaactgaacctgaacgtgattcacgacggcagtgcgacatctgacgaagcttcagacgaccacattgcgagtccgcagtacggttctattccgtttcacctgccggctcaggctgaccgtggcgaagtgagcgttgtgtttgaaaaaccgtttattgacacccagtacgttattacagcaaacgcctcaattctgggtgttatggtgagcgttacccagcgtcagcgctacagtgcagtgctgacagttgaacgcattcactctggtccgctgtgcgaaggcctggttctgtggattgcaatgggtcagcaccaccaccaccaccactaataagaattc

SEQ ID NO: 4330 - DNA, 1139 bp, Artificial Sequence
  Optimized for E.coli
ccatggacgctaacgacaacgcatttattctggacaaacgtggcgttctgaaagaacgttcttttcgcgacagcagtcgcgccggttcaatttggatgccgccgtttttcgttcaggaaattatgcagtcttcaagcaacctgtttccggtggccctgattagcgcggaacgtcgcggcgacctgagtgaagacgtgtaccgtctgaaaccgggtaactctccggactttaccgttgaactggctgtgacacgtctgggcatggcagacgaaagttcttcacgcggtgttccggtgattctgctgcacggcagctttagtaaccgtcgcttttggttttctccgaaaggtctgggcctgggtgcttacctggcacgtcagggctttgacgtttggattccggaaatgcgtggccacggtctgtcacagcgcaaccacgactaccgtaaaaaccgcgttgctgactacgctcgttacgacctgccggctattggtgcatttgttcgcgaacagtctggtcaggtgccgcactggattggccactctctgggtggcaccacactggcagctgctctgggtggcgaatacattggcgaaccggttgtggctagcgctgcatttttcggtacccaggttagtcgtacatactggccgctgaaaattccgccggtggaatggagcggccgttttattctgaaacgctttgcgcagctgtctggttcacgtctgaaacgcggcccggaagacgaaccgattggtctggccctggaaagtatgcgttggtttggcctgtttggtcgctttggtgacgctgacaaagactggtgggctggcctggcggaagttaaactgccagttctggcagtgagcgctgctggtgaccaccaggacccagcctgggcgtgtcgtaaactgtttgaacagtttggtagtgaacacaaacagtttattaacctgggccgcgaacagggctttggtgacaactttggtcacgttgaaatgctggtgagcaaagctgcacaggctgaagtttggccactggtgacacgctggctggcagaccagcagacaccgctgccgggtgcacagcaggacctggttgtggcggtgcaccaccaccaccaccactaataagaattc

SEQ ID NO: 4331 - DNA, 899 bp, Artificial Sequence
  Optimized for E.coli
ccatgggtcgtatttctctgttttcaggcacaccgaccgttattggtcacgacaaccgtggcctgaccgtgcgcgacattctgtacaaccgccacccgggtctgccggaagcaacagacgaacgtattacccgtcaccgctacgacgcacgcggctttctgacacagtctgctgacccgcgtctgcacgaacgcggtctggccaactttagcagtgttacagacgcagctggtcgtgttctgcgtgcacgcggtgccgacaacggtaccattgttatgctgaacgacgcggctggtcgtgcgtttatgacagtgtctaacattcgcaccacagaagacgacaccgaagacctgtcacaggcagttacacgtaactggcagtacgaaggtgcaattctgccaggccgcccggttagcatgatggaacaggtgacaggcaaaaccgcacgtattaccgcccgctttgtgtacgcgggtaacgctggcgaagaaaaagcgctgaacctggctggtagctgtgttagtcactacgacacagcgggcctggtgcagaccgacagcattgctctgacaggtgttccgctgagtgtgatttgccgtctgccgaaagacgcggacaacccggacgttatgaccgactggcagggcgacgacgcgagtctgtggaacgacctgctggactctgaatcacaggctaccctgaccacagcggacgctaccggtgcggttctgaccacaaccgacgctcgtggcaacctgcagcgcgttgcatacgacgtggccggtctgctgagcggcagttggctgaccgtgaaaggtggccgcgaacaggttattgtggcttctctgacatactcagcagccggtcagcaccaccaccaccaccactaataagaattc

SEQ ID NO: 4332 - DNA, 1331 bp, Artificial Sequence
  Optimized for E.coli
ccatggttgacatgcgtaaaggcgcgctgattagtggtgactcagctagctacagtgacctgaaccgtctgaaccagctgaaagttggcgacaaaaactcagaaggtaacctgcgcaaagtggcacaggaatttgaaagcctgtttctgggcgaaatgctgaaatctatgcgctcagccacagaagcgctgggtaaagacaacccgatgaacaccccggaagcgaaacagtaccaggaaatgtacgaccagcagctggctgtttctatgtcacgtgaaggtggcggtattggcctggcagacgtgctgctgcgccagatgagcaaaaacaaaccgctggccagtggtgaagcagccacactgtctgcggctaaacagcaggaagccctggacaaagcaaaagctccagttccaacaccggtggcagctggtaccctgccggacggtccactgtctcgcagtaacggtcagcgcccgctgtgggcttcacgcgcagtgtcagccccgcagggtgcagaaggtattcaccgcaacgacatggaactgattaaccagcgtcgcctggcactgccgccgaaactggctgaccgtctgctggctggtctggttccgtctgcgtcagtgaaaccggaagcggttgctcagaacgtgctgccagaccgtgctgttgctgctgtgaaaccggcaaccggcgaactggccaacggtgactggctggcagccctgaaagcggctgaaccgaaaggcgacatgcaggtttacggtcgtgcagtggcacagccgccgctggctccagctcgtaaagcatttcgcgacgccgacgaatttgttaacgcgatgctgccgatggctaaagaagcagccgaccgtattggtgtggacccgcgctacctggttgctcaggctgctctggaaacaggttggggtaaaagtgtgatgcgccagccggacggcagcagttctcacaacctgtttggtattaaagcttctaaaaactggacaggcgacagcgcacgtgccattaccagtgaatttcgcaacggtgaaatggttaaagaaaccgcagaatttcgtagctacgccagttaccgcgactcatttcacgacctggtgaacctgctgcagagcaacagtcgttaccaggacgttctgaaaagcgcggacaacccggaacagtttgtgcgcgaactgcagaaagcgggctacgctacagacccgaactacgcaaacaaaattagcaacattgcccgtcagatgacctcttaccagaactacgcgtcagctggtgcaaccacaaccctgcaccaccaccaccaccactaataagaattc

SEQ ID NO: 4333 - DNA, 722 bp, Artificial Sequence
  Optimized for E.coli
ccatgggtaacaccgacacactgctgcagtcaggcgctcaggcataccaggcagccaccctgtctgactcagacgttaaagcgctgtcagacaaaagctgtgctgaaatggacagcaaagaacagattgccccggcgagcagtgactacacaaaacgtctgaacaaaattgcggctgcactgggtgacaacattaacggcaccccggcgaactacaaagtttacgtgacaaaagacgttaacgcttgggcaatggccaacggttgcattcgcgtgtacagcggcctgatggacatgatggacgacaacgaagttgaaggtgtgctgggccacgaaatgggtcacgtggctctgggccacacccgtaaagcaatgcaggttgcctacggtacagttgctctgcgtacagctgcttcttcagcaggtggtgttgctgcaagcctgagtcagtctcagctggcagacctgggcgaaaaactggtgaacgcccagttttcacagaaacaggaaagcgaagcggacgactacagttttgacctgctgaaaaaacgtggtattaacccggaaggcctggcaacctcttttgacaaactggccaaactggacggtggccacgaaagcagtatgtttgacagtcacccgacatctgaagcgcgcgctaaacacattcgtgaccgcattgccgcgggtaaacaccaccaccaccaccactaataagaattc

SEQ ID NO: 4334 - DNA, 965 bp, Artificial Sequence
  Optimized for E.coli
ccatgggctcagaagaaaaagaaacagcgtacattgacgtggcagctgctaccctgtggacagctccgaacattctgcgtgaagtggacgctccgagtgcaaccaacccggttgacatgaaaaaatggaccacatctatggacctgaaacagaaacagcagctgagcagtgacggtatgctggaaacccaggcgctgtacggcaacaaagttacagtgctggaacgtcagggtgactgggttaaagtggcagttgacggccagccgacctcacgcaacgaactgggttacccgggctggatgccgaacaaacagctgacatacagcaaacgctacgaccagtacgctaaagacccgtttgtgatggttaccgcaccgaccacatacctgtaccactctccgtacctgaaaaagaaaggtattgaagtgtcatacaacacccgtctgccgctgctgacaaaaagcaaacgcgcttacaaagttctgaaaccgaacggtaaaacagcatggattagcgctaaagcaggcaaaatttacgccagtcagaaagacattccggtgccgaccggtacagaactggttgaaagtggcaaagcctttctgaacctgccgtacctgtgggcgggcatgtctggttttggctttgactgttcaggctttacctttacaatgtaccagtctcacggtattaccattccacgtgactctggtccacagagtcgtgcaggtaaaccagtggacatgaacaacctgcagccgggtgacctgctgtttttcgcctacaaccagggtaaaggcagcgtgcaccacgttgccatgtacgcgggtgacggcatgatgattcactctccgaactcagaacgtaccgttgaaattattccgctgaacacaaaaggttacattgaagaatacgccggcgcgcgtcgctacctgccgcaccaccaccaccaccactaataagaattc

SEQ ID NO: 4335 - DNA, 1811 bp, Artificial Sequence
  Optimized for E.coli
ccatggacaccgtggcagccaacaccagtacaccgctggcggctacaccgccgatgggttttaacaactgggcccgttttcagtgtacagctcaggctccaacagacggtagtgcacgcgccaactactcttttcagcactttatgctggaccaggcggaagctatgcgtgcaaccggcctggtggcctctggttacacactgctgtgggttgacgactgctggatgagtcgtattggttctggccagattcagggtgcagctcgttggggtggctcacagcagccaggttttgacccagacctgggtgcttacgtgagcgcagttcacgccaagggtatgctggcggctctgtacaacaccagtggcgccaaaacatgtcagggtgtggcagccggtgaacagggtcaccagctgcaggacgctcagacctacgtggcttggggtgttgacgcactgaaactggacaactgcggcgcgattgacaacgctacaccgcagcagctgtttaaacagatggcagacgcactgggtcaggcttcagctggtagcgcccgtaaaattctgtttaacgaatcagcaccagctggttacggtccaacaggttctgctaaatacgctacactggactgggttcgcccgctgggtcagatgtggcgtaccggtccggacattcgcaccacaagtatgacagcgggtggccaggctgcttctgacccgtgggactactacaacgcgaacgcttaccaggaaggtgtgtaccagtcttacaacgaaaccattgcgctgtcacgttacgtttctccgggtaactggaacgacccagaccagctgctgattggtgacaacggcctgacaccggcagaagaacgctcacagatggcactgtggagcgcaatggcagccccgctgattctgagtaccgacgttcgtaaatttgctgctaacccagctgacccgcgctggcagcagtctctggcgacactgaacaacgcggaagttgtggctgtggaccaggaccgcctgggtattggtggctaccgtgtttcacgcgacgacccgagcagttctgcgggcattgaagttgtggcaaaaccactggctgaccacgcactggctgttgtggttctgaacaaaggtgcagccagtgcctctccgaccctgtcatttagcaacctgggttaccgtaacggtgctgacggtaccccgtgtaccctggctgtgcgcgacctgtgggctcacagtggttctcagctggcggctcaggttccgctgaccattggcgcgcacgacaacgctatgctgaaactgtctggtacatgtggtggctgggctccaaccggcgaaattgaaacagtgggtgactggggcgcaaccccgctgtgtattgctgctggttcagctgctccgggtgcagcactggctctggctaactgcgacgcaggtccgaaacagcgttggagccgcaaagctgaccgtaccgttgaactggcaggtacaggcctgtgtctgtctagcacagcaccaggtgcaacactgggtggcgcggctggccagtgggcgaccctggctagttgcaacgcccaggacacaaaacagcagttttcttaccgtcgcaacggtcagctggcagctgctgctgacggtacctgtctggacatttaccgcggcgtggttgacggtaccctgggcaaaccgggtacaccgctggacctgtacgcatgcaccgccaaccaggtgaaccagatttgggcagccccgcacgcagacgttctgaacgaccaccaccaccaccaccactaataagaattc

SEQ ID NO: 4336 - DNA, 1121 bp, Artificial Sequence
  Optimized for E.coli
ccatgggtcagacactgccgccgccgacagttgcagcaaaatcatggctgctgctggacaccacaagtaaccaggttgtggcttctcaggacccggacatgcgtattgaaccggcgagcctggctaaaattatgaccgcatacgttgtgtttgacgccctgaaagacaagaaaattacactggaccagatggttaacgtgtcagttcgcgcatggaaagttgacccgagcagttctaaaatgtttattgaaccgaacaccccggtgtcaattaacgacctgctgtacggtctgatggttgtgagcggtaacgacgctgctgttgctctggctgaagcagtggccggtaccgaagacagttttgttgcgctgatgaaccacgaagctgaacgtatgggcatgaaatctacacactttggtaacccgcacggcctgccatcagctgacacctactctacggcacgcgacctggcaaccctggcagcacacgtgatcgttgacttcccggaattttacaaaatcgacagcaccaaaaaatacacatacaacaaaatcacccagccgaaccgtaaccgcctgctgtggctggacccgacagtggacggtatgaaaaccggccacacatcaagcgcgggctacagtattattgcgtctgctaaacgtccgaacgccggtggcgaccgtcgcctgctggctgttgtgattggtaccaacagtgacggcacccgcacacaggaagctcagaaactgctgaactggggttttcagaactttgacgcagttaaactgtacgcgaaaggccaggctattgacacaccgcaggtttggaaaggtgccaaatctcagattaaaattggctttacccacgacgtgtacgttacagtgccgaaaggtattgcggacaaaattaaaccggttctggaacgtaccgacccgctgattgcaccgattcagcagaacgccaaagtgggtaccgttaaagtgaacgcggacggcaaaacaattgctgaatttccggttgtggcactggaagacgtggcacaggccacaatttttggccgtgcctgggacagcattcgcctgctgtttaaacaccaccaccaccaccactaataagaattc

SEQ ID NO: 4337 - DNA, 1100 bp, Artificial Sequence
  Optimized for E.coli
ccatggccattaacgttagcgcaaaaagtgccattgtgattgacggtaccagcggccgtgttctgtttgcaaaaggtgaacacgaaaaacgtcgcattgcctctattaccaaaattatgacagcggttctggctattgaatcaggcaaaatggaagaaaccgttacagtgagcgcaaacgccgtgcgtaccgaaggtagtgcaatttacctgacagaaggccagaaagttaaactgaaagacctggtgtacggtctgatgctgcgttctggtaacgacgcagctgttgcgattgctgaatacgtgggtggcagtctggacggttttgtgtacatgatgaaccagaaagccgaacagattggtatggaaaacacccgttttcagaacccgcacggcctggacgaccacgaaaaccactacagcaccgcatacgacatggccgttctgacaaaatacgcgatgaaactgaaagactaccagaccatttctggcacaaaaatctacaaagctgaaacaatggaatcagtgtggaaaaacaaaaacaaactgctgaccatgctgtacccgtacagtacaggtggcaaaaccggttacacaaaactggcgaaacgcaccctggtttctacagcttcaaaagacggcgttaacctgattgcggtgaccattaacgacccggacgactgggacgaccacatgaacatgtttaactacgtgtttgaccactaccagacctacctgattgcaaagaaaggtgacattccgaaactgaaaggcacattctacgaatctaaagccttcatcaaacgtgacatcacctacctgctgacagaagaagaaaaagaagacgttaaaatcaacaccacactgctgaaaccgaagaaagcatgggaaaaagacgtgtcaaaaattccggacattgttggtcacatgaaagtgatgtttaacgacgaaaccattgctaaagttccgatttactacgaaaacgaacgcaaccagaaaccgaagaaaaaatttttcgaaacattccagagcatttttctgaacgcggcaggtggtgcaaaatggagtattcaccaccaccaccaccactaataagaattc

SEQ ID NO: 4338 - DNA, 1376 bp, Artificial Sequence
  Optimized for E.coli
ccatggttgaactgccggactttacccagctggttgaacaggccagtccggcggttgtgaacatttctaccacacagaaactgccggaccgtaaagttaaccagcagatgccggacctggaaggtctgccgccgatgctgcgtgaatttttcgaacgtggtatgccgccgcagtctcgctcaccgcgtgaccgccagcgtgaagcaacctctctgggttcaggctttattattagcagtgacggttacattctgacaaacaaccacgttattgcagacgccgacgaaattctggtgcgtctggctgaccgcagtgaaatgaaagcaaaactggttggtacagacccgcgttctgacgtggctctgctgaaaattgaaggcaaagacctgccggttctgaaactgggtaaatcacaggacctgaaagctggccagtgggttgtggcaattggtagcccgtttggctttgaccacaccgtgacacagggtattgttagcgcggtgggccgcagtctgccgaacgaaaactacgttccgtttattcagaccgacgtgccgattaacccgggtaactcaggtggcccgctgtttaacctgaacggtgaagttgtgggcattaacagtcagatttacacacgttctggtggctttatgggcgtgagctttgccattccgattgacgttgcgatggacgtgtctaaccagctgaaatcaggtggcaaagttagccgcggttggctgggcgttgtgattcaggaagtgtcaaaagacctggccgaaagctttggtctggaaaaaccggcgggcgctctggttgcgcagattcaggacgacggtccggcagccaaaggtggcctgcaggttggtgacgtgattctgtcaatgaacggccagccgattgttatgtctgctgacctgccgcacctggtgggtgctctgaaagcaggcgccaaagcggacctggaagtgattcgtgacggtaaacgcaaaaacgttgaactgaccgtgggcgctattccggaagaaggtaaagaaatgggcgcagaaccgaaatcttcagttgaacgtagcagtaaccgcctgggtgtgagtgttgtggaactgaccgacgaacagaagaaaacctacgacctgaaaggtggcgttgtgattaaagaagttcaggacggtccagctgctctgattggtctgcagccaggtgacgtgattacccacctgaacaaccaggctattggcagtacaaaagaatttgcagacattgctaaagcactgccgaaaaaccgtagcgttagtatgcgtgtgctgcgtcagggtcgtgcatcttttattacatttaaactggcggaacaccaccaccaccaccactaataagaattc

SEQ ID NO: 4339 - DNA, 1436 bp, Artificial Sequence
  Optimized for E.coli
ccatgggtcacggctacgtggaaagcccgaaaagtcgtgcgtttatgtgttctgctaccggtggcaacctgaaccgtgactgtggtccggttacatacgaaccgcagagcgtggaatacagcccgagtgttcagcaccactacccgaaagactactgtagtggtgactttaccaaatgtggtccagctaacggtaccattccagcaggtggtattacatctttttcacagctgaacgaacagaccgccacacgctggcagaaaaccacaattaaaccgggcatgaacgaatttacctggcactacagcgcgggtcacgcgagtgcttactaccagttttacattaccaagaaagactggaacccgaaccagccgctgacccgtgactcttttgaaatgacaccgctgctgaacgaaaacgcgggtggcgtgcgcccgccggcaggtggtaaaaccaaacacaaagtgaacattccggctgaccgttcaggttaccacgttattctggcaacatggaaaattgccgacaccgcagccacattttaccaggcgattgacgtgaacattgacaacgacggtgctccgattccggactggaaaaccctgggcgcagttcagccggaacagctgcgtgttggtgacaaagtgtctacccgcgtttttacaaacgccggcgaacagcagaaccgtcagacccgcctgtcaattgaaacagctgaacaggcacaggccaacacctggccgtttctgctggcacagcaggtgaacaaagcgaacgctggttacgttatgggcgaactgaacgccaacaacgaagttgtgccgaactacggtaaaaacacaatttacgcgaaaaacaacagcgacgttgtgcgcgttgaaattcagaaagaacagccgagcattccgggtgaactgaaactgagtggcctgcaggcagaatactctctgaaagactcagccacagacctgcactttaacgcaattgcccagggtggcaaatacaccattgcctctacagtgtttaacggtaaaggcgaatcaattgcgcaccagcaggcggaagctggtaacaacaccccgcacttttctattccgctgcgcaacgtttcagaaggcgaatacgacgttgtggttgtggctaaaccggaaaaaggtgaacagctgcagcagagtcagcgtattacactgaaagcagaagaagtgggtggcggtggcgactacgactttgtttttccgaaaggtctgaccggctacaaagcaggtacaaaagtgctggccaaagacggcaacgtttacgaatgtaaaccgtttccgtacagcggttactgcattcagtggaacgcaggcgccacccagtttgaaccgggtgtgggcagtaactggaaagacgcatggattcgtaaacaccaccaccaccaccactaataagaattc

SEQ ID NO: 4340 - DNA, 1571 bp, Artificial Sequence
  Optimized for E.coli
ccatggaccagtctattaaatacgaccacacctaccagacaccgtcatacattattgaaaaatctcagccgtcatggcagccggcccagaacctgacccagaaagaagcgctgtttagctacctggacaaacagcagacacactttaaactgaagggtaacgccaactctcacttccgtatctcaaaaaccatcaaagacagtaaaaccaaacagacctttttcaaactggaagaagtttacaaaggtattccggtgtacggttttggccaggcggtggctatgaaagaaaacaaacaggttaaaagctttttcggcaaagtgcacccgcagattaacgacattagtgttaccccgagcgttagcaaaaagaaagcaattcacacagctcgtcgcgcactggaagccagcattggtaaaattgaatacgttgacggcgaaccgaaagcggaactgtacatttacccgcacgaaggtgcatacgacctggcctacctggtgcgcctgtctacctcagaaccggaaccgggttactggcactactttattaacgccaaaagcggcaaagttattgacagttttaacgcgattcacgaagcagccggtaccggcattggtgttagcggtgaagaaaaatcttttgaagtgacagaacagaacggccgttactacctggctgacgaaacccgcggcaaaggtattaacacatttgacgcaaaaaacctgaacgaaaccctgtttacactgctgagccagctgattggttacaccggcagtgaagttgtgagcggtacaagtgtttttcacgacccagctgctgtggacgcacacgcaaacgcgcagaccgtgtacgactactactctcgtacatttggtcgccactcatttgaccagaacggcgctcgtattacctctacagttcacgtgggtacccagtggaacaacgcagcctggaacggcgttcagatggtgtacggcgacggtgacggcgcacgctttaaaccgctgagcggtagtctggacattgttgcgcacgaaatgacccacgctgtgacacagtactcagcaggcctgctgtaccagggtgaaccaggtgcactgaacgaaagcgttagcgacattatggcggctatgaccgaccgtgacgactgggaaattggtgaagacgtttacacaccggacgtgcgtggcgacgctctgcgctctctggaagacccatcaaaacagggtaacccggaccactacagtaaccgctacaccggcacagaagactacggtggcgttcacattaacagcagtattcacaacaaagcagcctacctgctggctgaaggtggcgtgcaccacgacgttcgtgtggaaggtattggccgcgaagcttgtgaacagatttactaccgtgcactgacctactacgttacaccgtcttcagacttttctatgatgaaacaggcggctattgaagcagccaacgacctgtacggtgaagactcaaaacagagcgcgagtgttgagaaagcgtacgacgctgtgggcattcagcaccaccaccaccaccactaataagaattc

SEQ ID NO: 4341 - DNA, 1091 bp, Artificial Sequence
  Optimized for E.coli
ccatgggtcagtcatacgtttacaaaaacctgtctctgccagacgtggacggtgttgctcgtgcaattaacaaccagggccagattgtgggtagcagttactttgaaggcgccggtaaccacgcgacactgtggtcaggtagcaccacaaccgacctgggcagtctgggtccgtcttcaagcgcagcccgcgcaattaacggcagtggtcagacagttggttactctctgtacagttctacctcaattacagccaccagctggaacgcggctagtggttctccgctggctctgagtccaggtacccagtctaacgcccgtgcgattaacaacgctggccagattgcaggttacaccacagcagcaccaggttcaagccgtgcaacaatttggaacggcaactctacaacctacctgccgaccctgggtggcaacgactacgctctgggtattaacaaccacggcgttgtggttggtgacgcatactttacaggctcagaagctagccacgcaatggtgtgggacggtggcggtgttcgtggtctggacgctctgggcggtgtgggtagttctgctgctgcagttaacgacaacggcgcaattgtgggttcaagccagctggccaacggtacatggcaggcgaccctgtggaacggcgacaccatttcaaacctgggtgctccaggttacgacggcggtcaggcttgggcaattaacaaccgcaaccaggtggttggttacacatacaccggcaacaacaacgacagttctacatggcgcgctacactgtgggacggcggtcgtatggtggacctgacatcatttgttgactcagactctcgcgctgctggttgggttctgacccaggcctacggcattaacgacaaaggctggattgtgggtgaagcgacaaacatgcagacctttagccgccacgcttttctgctgagtgtgtctgcagttccggaaccgagtgcctacgcgtctctgctgatgggtctggcctgtatgggcgtgctgtacggtcgtcgcgttggcagcaccaagaaaaacccgccggcgcaccaccaccaccaccactaataagaattc

SEQ ID NO: 4342 - DNA, 1124 bp, Artificial Sequence
  Optimized for E.coli
ccatggaaccagcagctgcttctgctgtgtgggttggtagtgccccggcgggtaccaaaattctgccaggcgaccaggtgacaagcccaaacggccagtttaaactgattatgcagggtgacggcaacctggtggaatacggtattggcaaccgtgttctgtgggcttctaacaccgcaggcaactcaggtgctattgcagttgtgggtaaaaaccgcgccctggacattacaaaaaacggtaaacgtgttgctcgttgggcatctgctggtaccgtgaacagtacagctctgaaagttcgtgcagacggcacaatggcactgctggcgggtaaaacagttgtggtttcttggaacggctaccaggaccgtgtgccgtctggtaacaccattctgggtggcacagttctgcgcagcgacaccagtaacacacgtattctgaacatgcgcaccgacggcaacctggtgcagaaagttagcggtcgtgtggtttggcagtctcgcacaggtggccacccaggtgcttgggcagaactgcaggccaagggtaactttgtgatttggacccgtgacgcctctcgtaagaaagttgcgctgtggagcagtcgtacctctacagcgggttcaggcaacctgctggtgcaggttgacggcaacgtggttctgtacggtgctaaagacacccgtgtgtggtcttcacgcccggttacaggcctggcatggccagtgaacggtaccaaaattacaggccgttacggtgacgaccgcggtgctggtcacgttccgcgctaccaccagggtacagacgctccagtgccagttggtacagcagtgtacggtagcggcaccggtacagttaccaaaacaattgcgaacgacgctgcatacggcaactacattgtggttacctacggtatgacagccgtgctggttgcgcacctgagtaaaattgaagtgaaacagggccagattgttaaactgggtaccgaaattgcaaaatctggcaacaccggccagtcaacaggcccgcacgtgcacgttgaaacccgtcgcaacggtacactggtggacccgctgaaaaacatgcactttcgccaccaccaccaccaccactaataagaattc

SEQ ID NO: 4343 - DNA, 1409 bp, Artificial Sequence
  Optimized for E.coli
ccatggcaaccattaaagtgaaaagtggtgactctctgtggaaactggcccagaactacaacacaagcgtggcagccattaccagtgcgaaccacctgtctaccacagttctgtcaattggccagacactgaccattccgggtagtaactctggcacaagcagttcttcaagcggtagtaccgccaaaaaatcaggcaacagcgtttacaccgttaaatctggtgactctctgtggctgattgcgaacgaatttaaaatgtctgtgcaggaactgaaaaaactgaacggcctgagttctgacatgattcgtgctggtcagaaactgaaagtgtcaggcaaagtttcaagcaacagttcttcaggtaccagcagttcttcaaaaagcagtaaatcttcaaaaagcagttcttcaagcagtgcctcaacaggtacctacaaagttcagctgggcgacagcctgtggaaaatcgctaacaaagtgaacatgagtatcgcagaactgaaagttctgaacaacctgaaaagcgacacaatttacgttaaccaggtgctgaaaaccaaatcagccggtagcaactcttcaagcaaaaacaacagttctaaaagtaaccagtcagctagcgcaaccacaaaatacacagtgaaaagtggcgactctctgtggaaaattgcgaacaaatacaacctgaccgttcagcagattcgtaacagcaacaacctgaaaagtgacgttctgtacgtgggtcaggttctgaaactgacaggcaaatcaagcagttctaccagcaccacaccgtcaagcagtaactcttcaagcggtaccacaaccacaacctacacagtgaaatcaggcgacagcctgtgggtgattgcccagaaatttaacgttaccgcgcagcagattcgcgagaaaaacaacctgaaaaacgacgttctgcagattggtcagaaactgacaattaccggcaaagctagttcttcaaacagcagttctggttcaagcggcagcacaatcagtacctctgcaaaaatcaacaaaatgattgcggctgcaaaagaccacctgggtgttccataccgttggggtggcacaaccccggcaggttttgactgttctggctttatttactacgcgctgaacaaagtgacatcagttagccgcctgaccgccgcgggttactggaacacaatgaaaccggtgtcacagccggctgtgggcgactttgttttctttagcacctacaaagcaggtccgtctcacgttggcatttacctgggtaacggcgaatttattaacgctaacgactctggtgttgtgatttcaaacatgaacaacagctactggaaacagcgttacctgggcgcaaaacgctactttcaccaccaccaccaccactaataagaattc

SEQ ID NO: 4344 - DNA, 2996 bp, Artificial Sequence
  Optimized for E.coli
ccatggaccagcagcgtcaggttgtgggtaccggcctgacaaaaccagctggtacagttgtggacccagtgggtaaagtttgggtgtctgactcagttgctggtttttgtcgcatgtcagacccagtgaacggtcagccaggtaccgttgaaaaagacacctgtctgggtggcagcctggctggcagtcagcagggtccgaaagtgccgggcgttgctaccattctggacccgacaccgagcagtgctggttctggcgacgaaaccgcatttattccggactcttcagtgggtagcagtcacgttgtgcgtgccgtttggtcaccggcgctggacctgtttgaatactcttcaaccctgacaattctggacggcgacgtgcgtccgaacgcagtttcagacggcccggacggtaacatttacctgagctttgctaacgcacgcagtatcatcaaaatcgttgacccgaccatcaaacacccgagcattgaaagtattgcctctgtgaccacaaaagctctgggcctggttgcagctggttgggacagcaacggccacgttagtgtgtacgttctggaaaccacaggcatgcgcgccttttctgcgccggacgacggtgacatgaccaactacgtgccgctggcctcatacaacgtgggtgttgcgagcagtatcttttacgactacgacgcccacattatttacaccggcacatcttcaggtgctaccgcggctgacgcaggcaaagacaaagtgtctcgtctgaacctgtcaaccggcacagttgacaacagctgggcactgggtttttcaaaaatttctggtctgggtatgcgtgctggtcagctgctggttctggacgacgctggtcagctgaacaacccgccggcaaccggtcagggcaaaatgagcctgctgggtggcgttgtggcccagattaccagtggcccgacactggcgaacggtagccagagtccgaacccggcttttaccaacgacaccacaccgacatttggcgtgtctgctgacccgtctggttcagcactggaatgttcagttggtggcgcgtggacagactgcacaagcggtacctacacaagtgctgtgctggcaaacggtccgcagaccttttctgttcgtccggcaccgggtggcgtgccggttagtcgtacctttacggtggacacagttgctccggcagcaccagtttttacagctccgaacagcggtcaggttgtgaacggcaaaccggtgctgggtgcgacatttgaaccgggtaccacactgagctgtagtgtggacagtaccgccgacgcggactttaaagcttgcgttccgggcgacacctttacactgaccacagaaggtgcacacaccctgcgtattcgctctacagacccagctggtaacgttggtccagctgctgcactgaccgtgacagttgacctgaccgctccgcaggtggcaattacagctccagcatcaggtgcaacagttggtgctggttaccagtttcagtttgcttctacatcaccggacattgcaggctttcgttgtcgcctgggtaccgacgcatttaccgaatgcacaagcccgaaagtgtacgccgacattgcgaacggtccgaaccgttttgaagttgaagctcgcgacaaagcaggcaacaccacagtggcaggtgttaactttaccgtgtttgttgctgacacaacaccgccgacagtgacagctgacccagttgctggtacatacggtccaagcagtaaaattgctctgaccgcaagtgaagccgacgcgaaaatttactacaccgaagacggctctacaccgaccacagcatcaaccctgtacacagccccgattgcgatgggtagcaaaacactgaaatacattgccgttgacgccgcgaacaacgctagtgcaccgcagacccaggtgtacgttctggacaacgttgcaccagctgttacagctaacccaacaggtggcaacctggcactgggccagagcgtgacactgaccacagaaagtggtgcaaaaatttactacaccacagacaacaccacaccgaccgtggctagccaggttgcaaccacaaccgttaccattacaccggctgcaacaaccacagtgaaatactttgccgttgacgccgcgggtaaccagtctgctgtggcatcacagacctacacactgccggctgcaccggcgaacacctggaaagactacaactctgacgctaaaaacgacgttctggcccgtgactcagcgggtacactgtggctgtacccgggtaacggtaccggtggctggctgggcaaagtgaacaccggtacagcatggaacaactacaacctgattgttccgacccgcgacttttctggtgacggccgttcagacgttctggctcgtgacggtgctggtcagctgtggctgtttaagggtaacggtacaggtggctggcagccagccgtgagtgttggttctggctggtcaggcatgaccgctattgttgcaccgggtgactttaacggtgacggcaaatctgacgtgctggctcgtgacgctgcgggcgttctgtggctgtacaaaggtgacggcctgggtaaatttaccgccggttctacacaagtgggcgcgggttggaacgttatgaacaccctgttttcaacaggcgactttaacggtgacgccaaaacagacgtgattgctcgcgacaccagcggtggcctgtggctgtacccgggcaacggcacaggtggctggggtacccgcacacagattggcagtggttggggtggcatgacagctctgctgggtccgggtgactttaacggcaacggtaaatctgacgttctggcacgtgacgcttcaggtaacctgtggatttacccgggcaacggaacaggtggctggctggcatggagccaggttggtaacggttggcagggttttaccagtctgccgcaccaccaccaccaccactaataagaattc

SEQ ID NO: 4345 - DNA, 233 bp, Artificial Sequence
  Optimized for E.coli
ccatggaccgcccgggtgcgggctgggttaccattgaaaaagcaattgaaaccgccaaaacaaaagcgggttacatcgaaatctacaaaatcgaagctgacaacaacggttactgggaaggtgaaggccgtaaaagcgacggcgttgtgtacgaatttcgcattgacggtgcaagtggcaacgttgtgcgtgaccagaaagaccaccaccaccaccaccactaataagaattc

SEQ ID NO: 4346 - DNA, 206 bp, Artificial Sequence
  Optimized for E.coli
ccatggaaaacagccagaacaacatgggcaccaacgacaacggtcgtacacagatgctgaccacaaacaacaacgacgacgacaacgacaacgacaactggggttggctgggcctgctgggtctggttggcctggcaggtctgaaacgtcgcgaaccggaaaaccacaaaaaacgccaccaccaccaccaccactaataagaattc

SEQ ID NO: 4347 - DNA, 182 bp, Artificial Sequence
  Optimized for E.coli
ccatgggtagcaacgcggactgtgctcagcagattcgtagccacagcagtgaagcagccagtggctacatttacgttaaccgtctggacgcaccgcagaaaagcccagtgaacgcaccagcacgtgctgctgaaaaatcttcagcacactggcaccaccaccaccaccactaataagaattc

SEQ ID NO: 4348 - DNA, 317 bp, Artificial Sequence
  Optimized for E.coli
ccatggcaaagaaagcactgccggtgaccctgcacgttgaaaacgcagacggttctccggcagccggcgttaccgtgacagttatgaaagcggctgaatcagaccaccagccgaacattgaccgtggtgaaattattggcaaaaccgaccaccacggtgaaatgacatggaaaagcggtgcgaaaggcacctacgctgttgtgtttgaaaaagacggcgtgccggaaacacgcaacattagcctggcagaaagtgacaaacacaccgttatttctattacactgaaacaccaccaccaccaccactaataagaattc

SEQ ID NO: 4349 - DNA, 770 bp, Artificial Sequence
  Optimized for E.coli
ccatgggttctaaatcaattgcagtgtcacagcagagccagcagctgcacaacgacgtgcaggaagccgttaaatcaattatgggtgcaacacagctgaaagccagcgactacggtcgtgtgctgcgtagtgcactggcagcctctcagaaaaccgttacaattgaaattgcggctggtgacctgaccctgctgaaaaaatctaactacaaactgtgtttcgcaaagaaagttggcgacgctgactacaacgttgtgtggcagagttacgacgcctacctgtcaaacaacgaatttagctggacaccgcagtaccagctgtttgcaagtaacctgtttaaagccaacgttcaggtgaaagtttctaccaacattgttaacattggtctgggccagacctcaacactggacgaacacggtctgctgagcagtgcggtgacaggtggcccgaacattagcatgacctttgttaacgactacgctccgattcacccgggcattaaccagctgagtacaggtattgacggcaaccaggtgtctaccccgatttacgtggcagttgaccaggttgtgaccggtgaaacagtgctgaccccggttgaaacaattctggtgtggtttgaacagaacgttcagacctctacaatgtttagcaccagtcgttctaaagcgattgaaattgacctgacatttgacaacaccgctggccgcctgtacgaaggtggccagtggaaaaccgttcaccaccaccaccaccactaataagaattc

SEQ ID NO: 4350 - DNA, 1073 bp, Artificial Sequence
  Optimized for E.coli
ccatggaatggccggcgtggcagcagtacaaacagttttacattagcgacgaaggtcgtgttattgacccgagcagtccgaaccgcattaccacaagcgagggtcagagttacggtctgtttttcgcactggtggccaacgaccgtccgacctttgacaaactgctggaatggacagaaaacaacctggcagctggtgacctgtctgcacacctgccggcatggctgtggggcgaagacgacaaaaaacgttggaccgttctggacaccaacacagcgagcgacgctgacctgtggattgcgtacaacctgctggaagctggccgcctgtggaaaagtcgtcgctaccagaccctgggtacactgctgctgcagcgtattggccgcgaagaagttgcagacattccaggtctgggcctgatgctgctgccaggtaaaattggctttgttgcacaggaccgttggcgcctgaacccgagctacctgccgccgcagctgctggctcgttttgctgctctgaacggtccgtggcgtgctatgcagaaaaccaaccagcgtctgctgctggaaacagcgccgcacggcttttctccggactgggttgtgtggcaggctggtaaaggctggcagccggacacagttaaaccggacgtgggttcatacgacgcaattcgcgtttacctgtgggtgggcatgctggccgacgacgacgaacacaaagcagccctggttaaacagctgctgccgatggcgcagctgacagctcagcagggtgtgccgccggaaaaaaccgacacagcgtctggtaaaacatcaggtgacggcccggttggcttttctgcagtgatgctgccaatgctggcaaaccagacagctgctctggacgttcagcgtcagcgcattaaccagcacccgccgggtgacgacgcatacttttctgcctcactgacactgtttggtcagggctgggaccagcagcgttaccgctttaaccgtcagggtgaactgcagccagcttggggtggccagtgtgtgacctcaaaacaccaccaccaccaccactaataagaattc

SEQ ID NO: 4351 - DNA, 599 bp, Artificial Sequence
  Optimized for E.coli
ccatgggtaccccgacagcgctggctgacaaatttgcgtctaccgtgacagacgacggttggaccctggacctggcagcaacaaaactgtcagctaacccggttccgaacctggcaaccacagcctttacccgtgaaggttttgtgagcgcaaaagttaccggtacaattggtggccagggcgacagtgccgtgaaaaccggctacgttgaacagggtctgcagattggctgtcagattgacgtgagcagtggtctgggcctgggtctgggcttttctctgggtccgtcagttggcgtgagcattagtggtgtgccgagcgcaaacgttggcgtgaacgccagtgttaacccgagcattcagagtaccattgcaccgggtacaattaccacaattccgctgggtaagaaagacctggaatcttcaaaagcgagcattaccgctgaaaacgttcacgtgaaagttgacgcgtgcatgggtccggtgacaattcgcagctacgcgcagctgtctgtttcaaccgctacatctgacaacaccctgtttgtttactcagacccgacatggctgcaccaccaccaccaccactaataagaattc

SEQ ID NO: 4352 - DNA, 233 bp, Artificial Sequence
  Optimized for E.coli
ccatggcgagcctggttagcagtgaacaggctcagggtctgcagccgatgaaccagaccatttctattggtggccgtaacggcgaccagacacacattcgccaggttctgtctgaaaaagcagacgcccagggtgcatcacactaccgtattattgaaaacaaccaggacaacacctggcacgtgacagcggaactgtacaaacaccaccaccaccaccactaataagaattc

SEQ ID NO: 4353 - DNA, 359 bp, Artificial Sequence
  Optimized for E.coli
ccatggcggacggttacgaccgttgtccggacggctactactgcatgtttagcggtctggacggtacaggcgacatgattgctctgcgtgaagacaccccggacctggcagcactgggtatgaacgaccgtgcaaaaagcgactggaaccgcaccgcctctacaatttacctgtggtcagacgcacagtacaccggctgtacagcggttaccagtgctggtccgaccggtaaaggcaactttttcccgacctaccaggactttttcagcagcgttcagtttgacggtccgggtggcccaagctgtggtacaccgccgggtgaaggccgtcaccaccaccaccaccactaataagaattc

SEQ ID NO: 4354 - DNA, 272 bp, Artificial Sequence
  Optimized for E.coli
ccatgggtagcgtttacgtggcatacgaaggtccgggctttagcggtcgtagtgttgcactgagcgcctgtggcattaacaacattccgtttggtggctcttacaaacggtacggtaccggccagtcaggtcgtatgtacaacctgccgaacgcgcagggcgttgctcactttaccctggacagcaaccgcaacgcggaacagattacaccggtgggctggaaaagtgtttttattgtgtgccaccaccaccaccaccactaataagaattc

SEQ ID NO: 4355 - DNA, 2468 bp, Artificial Sequence
  Optimized for E.coli
ccatgggtaatcaaaattacaaaaacaatgagtatgagattttagataatggtaatgcaggctatcaaccaaggtatccgcttacgaaggcaccgtattctgaattacgaaatatgaattacaaagattggatgaataggtgtccaaatagaatcgctgttgttcctgcggaaggttacgatgtaaatataagagatgcagtcattacaagtatcaacatcctcacctcccttctttcacttgcaatcccagtagctggagtagcgggagggatcatcagtgcaatttttggttggctttggcctactaatacagaggaagtatggcaggcttttatgtcagcagtcgaagatctcgtggaccaaaagattgacgattttgcacgagagcaagctattgcccggttacgtggtatgcatggtgtcctagagttatatgaaactgcagtaagtaacttgcaaaaggatcctcaaaatgaaagactaaaagaaaatgtccgagatcaatttgtagccactaatacatttgttgttggttcgctgcccctgtttcgtgtccgtggatatgaagtacctatgttagtggcttatgcggaagcagctaatctccatcttcttctcctacgcgatgcggtaaagtttggaacaagttgggggatggatgcagccactgtaaatggctatcaaagaaaccttgagactgggataacagtttacacagatagttgtgtggagacatacaacaaaggtatagaaaaaactaagacattaaaagcaaatgtaaaggattatgatagatatccatgggcacaataccatgatttactcccatctttaggtggtagtcctgaaaaggattttcaaaatatagaaaattggaatttattgaatagtttccaaagagacatgacccttatggcattagatcttgtctccatatggccaacatataattcaaaagaatatccattgccagtaaaagcacagctcacacgagagatatataccgatttacgtggatgttatgcgggggacataaacagtacggaagctcaaatagtcagaccaccacatctgtttacattctttcaatcagctaccctatatacaggaaataatccttttactccgtatgttggtattcaacagagtggacattacactttaggaccaagtttcacaaccgcggtcaatggaatctctgaaggcgctcctaataccgttactgctaacccgtcagatgcgattatcaataaagttgatatcgataccgggaatgaactatatcgatttatgttttaccaagaaaattacactcaaccatttaaaaccgtgggagagaattctagtctcgggtatgtgagaaccataaatcgaattcctattgagggtgatcaaacgctagctaaccacagaatgtcatggattagcggttctttgcgtccagcatcgaccggtccaatgggaacccagattcctccttacatctcgtgtgcagctttaggttggactcatatcagtgcaaatcgagacaataggattgtttcggatagaatcactcaaattccggcggtgaaggcgtactggaatcgaggtgctttttcagttgtgaggggacctggttcgacaggaggggatttagttcgattaagctcttctggtgaagtgtcaattaaggtgagaccatcgcgtactggtatatttaactatcgtgttcgaattcgatatgcggctgtagcgagtggaaaacttaatgtcaaaaagtacgttaatcatatacatgcttctacaacgtatgattataaacaaacgactgctggtaatcttacgtattcatcgttccaatatttggaggtttacaacttcactctagcagaatctcaatttgaggtctggctcaccaatgagaccggcggtcctatctatatcgataaaatcgaatttataccgttaacgccaaaaccagaaccaaagccaatagtaccagatggtacctatcaaatcgttacggctttaaataatagtagtgttgtagacctggatcagagtcccactcctccaaattgggcttcacctcgaaatgttcaattatggggaaatggtaacgctactaatcaaaaatggaagttcgtatatgatgaaagtaaatatgcatatcaaattataaatctagcaaatccgaaggaagtattaacctggtctttcaatgtagagagactatccgaggtgaatgctgtaccaaaccagcaagataaccgccagtattggatacctgaacatgcaggaaatgggtatttttatttgaaaaatatggaagatgcaaacgaagcatacggagcattagatgtaagtaatgctagtactgcaaatggaacgaagattatatacaatggctttaatggtggcacgagtcaaaagttcaaactgaataggttgagtcaccaccaccaccaccactaataagaattc

SEQ ID NO: 4356 - DNA, 920 bp, Artificial Sequence
  Optimized for E.coli
ccatgggcagcagtaccgacgttcaggaacgtctgcgcgacctggcacgtgaaaacgaagccggtaccctgaacgaagcgtggaacacaaactttaaaccgtctgacgaacagcagtttagctacagtccgaccgaaggcattgtttttctgacaccgccgaaaaacgtgattggtgaacgtcgcatttcacagtacaaagtgaacaacgcatgggccacactggaaggcagcccgaccgaagttagtggcacaccgctgtacgcaggtaaaaacgtgctggacaacagcaaaggtaccagtgaccaggaactgctgacaccggaatttaactacacctacacagaatctacctcaaacaccacaacccacggcctgaaactgggtgttaaaacaaccgccacaatgaaatttccgattgcgcagggctctatggaagcttcaaccgaatacaactttcaggactcttcaaccgacacaaccacaaaaacagtgagctacaaaagcccgagtcagaaaattaaagttccggcaggtaaaacctttcgcgtgctggcctacctgaacacaggctctatttcaggtgaagcgaacctgtacgctaacgttggtggcattgcttggggcgtgctgccaggttacccaaacggtggcggtgttaacattggtgctgtgctgaccaaatgtcagcagaaaggctggggtgactttcgtaactttcagccgagcggccgcgacgttattgtgaaaggccagggtaccttcaaaagtaactacggtacagacttcatcctgaaaatcgaagacattaccgactctaaactgcgtaacaacaacggctcaggtacagttgtgcaggaaattaaagttccgctgattcgcaccgaaattcaccaccaccaccaccactaataagaattc

SEQ ID NO: 4357 - DNA, 2015 bp, Artificial Sequence
  Optimized for E.coli
ccatgggtaccgaactgacaccgggtattgcagccccgctgggtgcacactacgacggtaacggcattaactttaccctgtttagcgcacacgccacaggcgtggaactgtgtctgtttgacggtcagcagcgcgaagttcgtctgccactgccagcacgtagtggtgacatttggcacggttacctgccgggtggcaaaccgggtcagcgttacggctaccgtgtgtacggtccatttgacccagcacagggtctgcgctttaacccgaacaaactgctgctggacccagctgctcgtgctgtggaaggtccggttgctgacgacctggaactgcacggtggctacgaccgtccagacccgcaggactctgcggaagttatgccgaaatgcgttgtgattgacgaagcatacgactggcaggacgaccgtccgccggcaaccccgtggggtaaaacagtgatttacgaagcacacgttcgcggtctgacactgctgcacccggacattccgccggtgctgcgtggcagttttgcagccctgggtcacccggttatgattgcgcactttaaacgtctgggcattacagctctggaactgctgccggtgcagcagcactcttctgaaccacgtctgcagcgtctgggcctgattaactactggggttacaacgttctggcaccgtacgccccggacaaccgctactgtagcctgcgtaccgacatgacaccgctgcgcgaatttcgtgacgcggtgaaagctctgcacaaagcgggtattgaagttattctggacgttgtgtttaaccactctgctgaactggacatggacggtccaaccctgtcactgcgtggtattgacaacccggaatactactggctgacaccggacggcgaatacgtgaacgacaccggttgtggcaacacactgcgtctggacaaaccgcagggtgtggcctgggttatggaatgtctgcgcttttgggtgtctgaatgccacgttgacggctttcgttttgacctgggttcagtgctgggtcgtaccccggcatttgaccgtgacgccccgctgtttcaggcaatgctggccgacgacctgctgtctcgctgcaaactgattgcggaaccgtgggacattggtccgggtggctaccaggttggtgcatttccgggccgctttgccgaatggaacgaccactaccgtgacgacatgcgtcgcttttggctgcagggtgacctgccgctgggccagtttgcacagcgttttgccggttcttcagacctgtttaaccagcgtggtcgtgctccatacgctggtattaacatgctgaccgcccacgacggctttacactgcaggacctggtgtcatttaaccgcaaacacaaccagctgaacggtgaaggcaaccgtgacggtagcgaccacaactttagttacaaccacggtgtggaaggcccgattgcagacgacgccattgttcagcgtcgccgtgctagccgtcaggctctgctggctaccctgctgctgagtcagggcacaccgatgctgctggctggtgacgaacacggccactctcagcagggtaacaacaacgcgtactgtcaggacaacgctattacctggctggactgggcgaaagctgacgactcactgaccgcatacacagcggctctgattcacctgcgccgtcagattccagcactgcagcaggaccgttggtggcaggaaggtgacggctctgttcagtggctgaacgctcagggcctgccgccggcagcacaggaatgggaacagggtgacctgcagctgcagattcgcctgtcacagcgttggctggttgtggttaacgctaccccgcagccagtggaaatgcgcctgccagctggtgactggcaggtggttgccccgtttacacaggaaggtagccgtgcggttctgccggcttggaaccaggcggctcacagtatttgcgtgctggttcagaaacaccaccaccaccaccactaataagaattc

SEQ ID NO: 4358 - DNA, 1403 bp, Artificial Sequence
  Optimized for E.coli
ccatggacgacctgccgtctctgggtgacgcaagcagtgccattgtgtcaccgcagcaggaataccagctgggtcgtgcttggctggctatgctgcgtagccaggttcagcagctgagtgacccgcagctgaaagactacgttgaatcttcagtgtacaaactggttgaaacctctcaggtgtcagaccgtcgcctggaatttattctgattaacagcccggaactgaacgcctttgcagccccgggtggcattgttggtgtgaacggtggcctgtttctgaacgcgcagacagaaggcgaatacgcgagcgtgctggctcacgaactggcacacctgagtcagcgccactttgctcgtggtgtggaagcaagccagcgcatgcaggttccgatgatggcggctctgctggcaggcattgttattgcagctgctggtgcaggtgacgctggtattgctaccattgctggcacacaggctgcagccattcaggaacagcgtcgcttttctcgccagaacgaacaggaagctgaccgtattggtattattaacctggaaaaagcaggctacgacccgcgttcaatgccgaacatgtttgaacgtctgatgcgccagtaccgttacgacgccaaaccgccggaatttctgctgacccacccggttacagaaagccgcattgcggacacccgtaaccgcgcagaacaggccaaacagggtggcattgaagacagtatgcgttaccagctgattcgtgcccgcgtgcagctgatttacgaagaaacaccgggtctgggcgccaaacgttttcgcgcgcagctggacgaaaacccgaaaaacgacgttgctcgctacggtctggcgattgctcagattaaaggtggccagctgaacgaagcacgtgaaaacctgaaactgctgctgaccacagccccgaacgaaattatttacaacctggcgcaggtggacctggacattaccaacaaccgtctgccagacgctcagacccgtgttgaccgtctgctgacacagtttccgggcaactacccgctgaaccaggttcgcgtggacctgctgctgaaacagaaccgtaccgcagacgccgaaaaagctctggaaaacctgctgaaatctcgcccggacgacccggacgtgtggtacatggttgcagaaacacgtggtctgtcaggcaacattattggtctgcaccaggcgcgcgctgaatactttgctctggtgggcgactaccgtcaggcaattcagcagctggactttgccaaacgcaaagcgggtggcaactttccgctgagcagtcgtattgacgcccgtcagcgcgaactgatggaacaggaacgtatgattaaagacatgatgggtcaccaccaccaccaccactaataagaattc

SEQ ID NO: 4359 - DNA, 1019 bp, Artificial Sequence
  Optimized for E.coli
ccatgggtaccacggcagacccagctccagctccagcaaccctgtctgtggcctcagcggacaaactggccggcacactgctgagcgaactgggtgacgaagcagccggcacctactacgacgcgaaagaacgtaaactggttgtgaacgttgtggacgaagacgctgctgaaggtgtgcgtgaacgcggcgctgttgcacgtgttgtggaacactctctggcagaactgaaatcagcccgcgcgacactgaaagctgaagcaaccattccgggtacatcttggtctgtggacccggttaccaacaaagttgtggttaccgcggacagcacagttaaaggcgctaaactggaaaaactgaacaaagtggttgacggcctggacggtcgtgcagctgtggaacgcgttgctggtgaatttaaaccgtttgcggcaggtggtgacgccattcacagcggtggcggtcgttgtagtctgggttttaacgtggttaaaggcggtgaaccgtactttattacagcgggccactgcggtgaacagggcagcagttggagcgacagtgctggcggtgcagccattggtacaatggaagaatcttcatttccgggcaacgactacgctctggtgaaatacgcctctggtgcggaccacccgtcagtggttaacctgtacaacggcagcacccaggaaattacacaggctggtgacgcaaccgtgggccagcaggttcagcgctctggttcaaccacacaggtgcacgacggtgaagttaccggcctgaacgaaacagtgaactaccaggaaggtagcgttagtggcctgattaaaaccacagtgtgtgccgaaccgggtgacagcggcggtagtctgtttgcaggtagtaccgccctgggcctgacatctggcggttcaggcgactgcagcagtggcggtaccacctttttccagccggttccggaagccctgagcgcgtttggtgctagtattggccaccaccaccaccaccactaataagaattc

SEQ ID NO: 4360 - DNA, 2018 bp, Artificial Sequence
  Optimized for E.coli
ccatgggtatgcagaccccggccccgaaccagctgtgtattgctgaccgcaacgctggcctgcgtcgcctgctgagcgtgccgtttaaacgcaacaaacagatgaaaagtgaaatctctgctaaagcactggcagccaactttgcgattccacaggcatcagctctgagcctggctctgagcctggtgtttgcatcactgagcgtgcacgcggctgttgctgacaacagtgcatgggttaccacaaaaacacaggcttttctgccgcaggtgcaggcaaaccagaaaagcgttgcagccgacgcatcagttgtgaccccggctgctacggctgtgcagctggctcagggtgaaccagttcacgtgaccctgagcctgaacctgcgtaacgaagcaaaactggacaaatttctgcaggacctgcacacaccgggtacagcaagttacggtaaatttctgacaccggcccagtttgcagccgaatacgcgccgaccgaaaaagacgttgctaaagttgtggcacacctgagtaaatctggttttgtgaacattcaggttgccccgaaccgtcacctggtgacagcggacggtacagcggctaccgttcagacaggctttcgtaccgcgctgaaacgctttcagcaggacggccgcaaagtgtttgctaacacagacgcagcacaggttccagctgctctgtcaggtattgttgacagcgtgctgggcctgcagaacgtggctattgcacagacacaccaccgttgggtgcagaccccggaagcgggtgtttctgcccaggcgaaagttaccgtgaacgctacaccggtggctaccgcacactcaccggttcagtttccggctatttacagcgtgggcaccacaccgacagcaagtaacaccgttgtgggcattattagtgccggtgacctgtctccgaccattacagacctgaaaacctttaccacagccaaaggtctggcgaccgttaacacactggttgtgaaaacaggcgcagccggtgcagactacagtgacacctctggtcaggtggaatggaacctggacagccagaccattacaggcaccagtggtggcgttaaacagctgatcttttacgcctctccggacatgtcatttagcggcattacagcggcttacaaccgtgccgttaccgacaacgttgcgaaagtgattaacgtttcactgggtggctgtgaaagtgacacacactctgacggtacccaggcagccgacgacaacgtgtttaaacaggccgttgcgcagggccagacatttagtatttctaccggcgacgcaggtacatacaactgccagaccagcagtattagtggcgccccgggtgtgccgaaaaacaaatcaacctacgacgttagcgaaccggcggctagtccgtacgtgattgcagttggtggcaccacactgtacacaaacagcggtgcctactcttcagaaaccgtgtggaacgaaggcctgagtgctattggtacctacgacgacgcaggcgactacgacagcacaaaacgtctgtgggcgaccggtggcggttacagtaaatacgaagcagccccgtcataccagagcggcgttattgcggctggtaaaaccacacgcggcctgccggacattgcatttgacgcagcctcagctagcggtgcaacaatttactacaactctcagacgggtacagtgggcggtacctcactggctgctccgatttttgctggtgtttgggcacgtctgcagtctgccaacaacaacgcgctgggctttccggcagcctcattttacaaatactttccggtggcggctaacgcgtctctgctgcacgacgttacctcaggcacaaacggtgctagcagttcttacggttacaaagctgctgctggttgggacgctaccacaggttttggttctctgaacattggtaacctgaacacatttgttaaaaacacctcagactttgctcgccaccaccaccaccaccactaataagaattc

SEQ ID NO: 4361 - DNA, 1109 bp, Artificial Sequence
  Optimized for E.coli
ccatggccaacgaagtgtttgcgaacaacatggaaattagctgtaaagcagccgacggtaaaagtgttgcggcttttccggacgtgtgctttaccccgccgcaggcaccgccgaccccgacaggcgttccaattccatacccgaacaccggtatggcgaaagacaccacacgtggcagccgcaccgttaaaattacacgtaaagaagtgatgctgaaaaacaaatcttacttcaaaacctcatacggtgacgaagctggctgtgcaccgaagaaaggtgttatcacctctaaaatcaaaggcaaagtgtacttcacatcttggtcaatggacgttaaatttgaaggtgaaaacgttgtgcgcaacctggacatgaccacacacaaccacgcaagccagccaggcaacagtccaacctggccgtacattgacacagcagccgcggctaacagcagtcacccgtgtcacaacgttgtgaaaggtctgaaagacaacaactgccagcgtcacgtggacgctaacacctacagcacagacgcaattaaccgcgcgggtgctagtgaagccctgtgtggcgacccgaaatgcaagaaagcaatggaatgcgtgctgaccccgtacgaaccgtctaactgttgcgacggtaaaacaccgcaccacattgttccgaaatcacagtttaaagaacgtggtaaaggtggcaaagcactgctgctggacgcacagggtgctaacaaatacgacccgaacaaagcaccgtgtatttgcgaagacggccacagccacagtaccggtacacacggcgacattcacgaagaaaccaacctgctgacagttaaccacccgaccgttaaaccgaaagtgaccggtaaaacaattgctccggacgcacgttggagcgttgcagaagctgaagctgtgggtgctgaagcagcacagaaaggtggcagtaaatgtgacaaagaatgcaccaaatctcaggtgcgcgaatcacaccagaaaatgaacattggtccgaccgaccagattcgtccatcaacagctggtcgtgttccagaaccatcaaacccaaccacatttcaccaccaccaccaccactaataagaattc

SEQ ID NO: 4362 - DNA, 290 bp, Artificial Sequence
  Optimized for E.coli
ccatgggtattgaccacgttacctgtgacccggaccgtggttacctgaaaatttggagccacctgaacggccgtgacagtgttgactgctacgcaaaccgcggtaaaaccaactttggcaactggtgggtggacaaaatttctaccggtaacaacgttgtgaaatactacgacgcaaacggcgacgttgtgaaaattgaccgtaacaaagccattagctacccgaaccgtccgccgaaagtgaaagcgattgaaattctgcaccaccaccaccaccactaataagaattc

SEQ ID NO: 4363 - DNA, 386 bp, Artificial Sequence
  Optimized for E.coli
ccatggcaacccacgcagccaaagcgctgcagattgctagcagcaagaaaggtagcccgtaccgttacggtgctacaggtccacgctcttttgactgttcaggcctgacactgtacagttacaagaaagcaggtaaaaaactgccacgtacagctgctcagcagcacaaccgtacaaaacgcattgcagccagcaaccgtcgcaaaggcgacctggttttctttcactctggtggctcagtttaccacgtgggtatttacgcaggtggcggtaaaatttggcacagcccgaaaagtggcgccgttgtgcgcctggaaaaaatttggacaggctctgttcgttacggtcgcgtgaaccaccaccaccaccaccactaataagaattc

SEQ ID NO: 4364 - DNA, 203 bp, Artificial Sequence
  Optimized for E.coli
ccatggcgaccgttgacacaagcgctacctacgttctggtgaaccgtaacagtggcaaagcactggacgtgtacaacttttctacagcagacggtgcccgtattacacagtggacccgctcagacgcgaacaaccagcagtggcagtttgttgacagcggtggcggttactaccaccaccaccaccaccactaataagaattc

SEQ ID NO: 4365 - DNA, 1184 bp, Artificial Sequence
  Optimized for E.coli
ccatggcttctacctgtgaccgttacgcatcatacccggttaaaggtggcacctacacagtgattacaaacttttggaacgacaaagcttctggttcacagtgcgttaacgtgaaccaggacaacggcgaatggagcgtgagcagtgcaccgtcttcaccagacagtaccccggcagcatacccagcaatttacaaaggttgtcactgggcgagctgcacaaaagacagtggcctgccgctgcaggcgaaagctattacctacgctccgacacgttggcgtgtgaccccgggtgccggtggcgactgggacattgcgtacgacatttggtttagcagtggtcgtgaagctccgccgtctggtcagccagacggtgcagaaattatgatttggattaaccacagcggtagtgttcagccggccggcagcaaaaccgcgaacgttaacattaacggcatgaactgggacgtgtggacagcatggaacaacccgagtggttggccgcgttggaacattgtttcttacgtggctacctcaccggttaacgcagtgaactttgacctggtgccgtttttccgtgactcagttggccgcaaagccgtggacaacaactggtacctgctggacgttgaagcgggtaccgaactgtggcgcaacggcgcaggttttgcctctggcgactttgacgttcagtttcacacagacccggtgaaaggtattgacccgaacaaatggtactcagttgtgaacaaaaactctggttcatgtgtggacgacgccgactttagcaccagtaacggtgccgttgtgcaccagtgggcttgtgacagccgtggcgcggctaaccagcagtggaaatttaccccgacagacagcggtaactaccgcgttagtacccagcaggctccaggcctggcttgggacgtggcaggttggggtacagcaaacggttctctggttcagctgtggacatacggtggcggttcaaaccagcagtggcaggctgttgacctgggtgacggttactacaaatttgtgggccgtggtagcggcaaatgtctggacgttccggcagcctctacctcaaacggtgttcagctgcaggtgtacgactgcaacggcacaccggctcagagttttaaactgattgcacagcaccaccaccaccaccactaataagaattc

SEQ ID NO: 4366 - DNA, 365 bp, Artificial Sequence
  Optimized for E.coli
ccatggaagacacctgtgctaaacagccgagcgacggtgcactgtttcagtgcacagttcagcagaaaaaactggccgaagacgaactgaacaaagaataccagaccgcgaaaaaacgtattgtgcagatgtacggcacacagaaaaaactggccgacgactacgttgcgaccctggtggacacacagcgcagctggctgcgttaccgcgacggccagtgtaaactggaagcttttgcagccgaagaaggcagtaacgcgaacgctgttgcaaccaacctgtgcgtgattcgtattgacaaagaacgcacagcaattctgaaacagctgccgtaccaccaccaccaccaccactaataagaattc

SEQ ID NO: 4367 - DNA, 392 bp, Artificial Sequence
  Optimized for E.coli
ccatggaagaagaatctcgtcagcgctcaaaacgcccgtacccggttcaggtggaaccggaagttcgtgaacgcattgacagcacccgtgaaatgccgcacaaagacattgacgtggaagaacaccacgcagaagaacagcacaaagttccggacattcagacagacaagaaagttgaaaaagaccgcgaaaacattaaagacgcgtacggtgaccaggactaccgtgcagcactgcgcggctttgctcgtaaagacgaagaaaaagaccgtcgcagccagattagtaacggtgaaaaagaaacccacaaaagcgaagacgaacagtaccgcgaagcgctgcgttctatgaaccagaaaaaacaccaccaccaccaccactaataagaattc

SEQ ID NO: 4368 - DNA, 374 bp, Artificial Sequence
  Optimized for E.coli
ccatgggtttttacaacccgtacgactacaacccgcactacgacgacccgtaccactacgttgaagtgcagcaccgtgttaaccgtttctttgaacacattgacggtaaaggcgcatcttttaccctgaactcaggtgaacgtctgagctacgtgggcgacgcatggaacgaccgtattagcagtgttcgcgtggccccgaaaaccctggttgtgctgtacgaacacattaactttacaggccgtaaaaaactgctggaaaactcttcaaaccgcagccacctgtttaacattcacgaagactttaacgacattaccagcagtattaaaacatttcgcctgtgtcaccaccaccaccaccactaataagaattc

SEQ ID NO: 4369 - DNA, 197 bp, Artificial Sequence
  Optimized for E.coli
ccatggcggaccagtctaaccagtaccgtgctcactacgttcagcaccaggcgccgcagtgggctgtgatgagcagtacctcagaaaacccgggtatggcacaggttgcagacgcaccagaagctgttgttctgccagcaaacccgcgcccggaaagctgggtgtttcaccaccaccaccaccactaataagaattc

SEQ ID NO: 4370 - DNA, 722 bp, Artificial Sequence
  Optimized for E.coli
ccatggcggaaaacattgaagcgaaagctattggtccgaaacacggcgcgaccctgattccgaaagctcgtcaagtgatttgtgaacaggacggtggctacaaccacccggacgacggcagcaacattccgaacgcagcctgccgcaacgcatttctgtacaaagccgaaaccattccgatttgggaacgtcgccagatgtttacagaatggccggcttactcacagaacctgcagggtacccagcacccgagcgacaaagtgccggacggtcagctgtgtagtgcaggcattgccaaatttgaaggtattgaccagccgcacgcagactggtacgtgagcagtgtttctgtgaaagacggccaggcaaccctgtactttgacgccacacaggtgcacgaaccgagcaaatggacagttagtctggccaaaccgtcttttaacgcggctaccgacaaactgaaatggtcagacctgacaccgctggaagttaccaaagttacagttccgccgccggcgaaaggcaaccacgttaaatacgctggtgtgtaccagattgaagttaaaattccggcggaccgtgctgacggcaaacagaccctgctgtacgtgcagtgggaacgtcaggacccggcacgcgaaacctttttcagctgctcagacgttcgctttaacggtgaaagtgcagccaaacaccaccaccaccaccactaataagaattc

SEQ ID NO: 4371 - DNA, 782 bp, Artificial Sequence
  Optimized for E.coli
ccatgggtcagattaccttttacgaaaacgacggctggcgcggtcgtacctttacagcgaaccagcaggttcgcgactttacacgtaacggttttaacgaccgtgctagcagtgttgtggttgaccgcggccagtgggaagtttgtgacgacgcaaactttcgtggcaactgcatggtgctgcgtcgcggtagctacgaaagtctgcgcggcatgggtatgaacgaccgcatttcttcagttcgtccggtgggtaaacgcaactcttacgccaacgaagctccagctccgctgccacagccaacctacgaataccgtcgccgtccgtctgaacgtctggtggaagttccggtgacctcagttcgcgcggtggttggtacaccggaacagcgctgttgggttgaaagccagcaggtggcggaaccggctcgtaacggcacaaacgttggtggcgtgattgcaggcgccctgattggtggcattctgggtcaccaagtgggtggcggtacaggtcgcgacgtggctacagctggcggtgcagtggctggtgcagccattggtaacaacatggcaaacaactctggtcagcagtcatacgcccgtgacgttcgccgttgcgaaaacgtgagcaacccgaaaccggaatactgggacgttacctacaactaccgtggccaggaacaccgcgtgcagatgagtaccccgccgggtcagagcattgccgtgaacagtaacacaggcgaaccgcgcatgcaccaccaccaccaccactaataagaattc

SEQ ID NO: 4372 - DNA, 2512 bp, Artificial Sequence
  misc_feature (2505)..(2506): n is a, c, g, or t
  Optimized for E.coli
ccatggcgttcatccagcgatattccacaaccaccaatggtgctgtaacattcactggcaacacgttggggttaagcaacataaacatttcatacaccgacatcggtgcattcataacgttggacctaagcaagcaagtgcctggataccctgccggcaccacgttggattggaaagaaaacgcgtctgccgcacagctaaggttgcccacaggcagcatcgttttgtatgctgagctaatatggggtgggtccacaaaaacgtccacagaagatgtaacgtctgaaatcgaccgtgccataacattaataagccccaaaggcagcacgctaataacgcctgaccccaccacatcgcagcaagtggcgcaagccaaccaaatattttatgtgcgatccgccaatgtaacatcgttcatcgatgcaggcggtgctggaaattacacagtgtccggtgtgcctgccactgtgcagcgttacaaaggcaacaatgtgggtggatggacgttatctgtggtttacaaagaccccacgttgccgttgcgaaacatgaacatccatgtgggaacagcatccatcgaaaaaaccgggtctgtgtcacaaaagatatctgggttcagcacgcctgaattgggtgatgtaaaagcgcgccttttgttaaccgcaatggagggtgacagcaaaatcccaggtgaccaattgttgttcggcaaagatgcgtcatcgttaaagcccatttccggccccaacaacccaatcgacaattttttcgcatcgcaaataaatgatgatgcaggaaatttggacacatccggcacgtatggcaatgtaaatgtaattccaggcagtgccggccccgctgtgcgatacaattgggacataaccaatgtggatgccagcactgcaatggaaaacagccaaaccgaagcattggtgcagttaacatccaaatcagatggatacatcgtaacaggcctgggtgtgcaaattgatgtcaacagccccgagataaaaataaacaaggaagtcgacaaagaagccgccatcgtgggcgaaattttaacgtacacgttgttaatcgaaaactcaggcatgacagaagcacaaaaaaccatcttaaaagatacgctgccgcccgagctaaaattcgtggaagacagcctgcaaatcgatggagtgcccatccccggtggtgacccgaccaaaggtgtggacatcggaagcatttccatcgagggccccaccgaagtcacattccaaacgttggtgttaaaagtgccgccagacaaccgtgctgtcaacaaagcaaccgtggtttatgatttccagtccgcgcccgggttgcccgtatcatcaggaacagctgattccaatgaagccataaccgtaataaggaaggtggaagtggaggtggtaaagcgccaagacatgtccgtgtatgtcaaagcaggaaacataataacatacaccatcgaagtggccaacaccggtgacacgcagctaactgatgtggtaatcgaagaccaaatccccaatggaaccaaattggtaacagggtcgttgcagatcgatggccgcccattttcaggcaacatcgaatcaggtgtaaacatcggcactgtggagcctggaaccaccacgcgtgtaacgttccaagtgctcatcgacaaccccgtgcccaaaaaagtaacaaacaaagccaaggtggattataaatacaagctcatccccgatggccaaatttaccgcaaagtcgaaatgaccaatgaggtaacagccatccatgaaagcaattgcaaggaagcgcaaaagaaaatcgtaaccggaatcggtgaagcagagctggccgctgctggtgtaatcgtggctgaaaaattaaaaatccaagatgccatccgcgcgttcaatgaaggcaagcaatccgccgaagagctgttaaacgagaatgagcaattaacgcacaaattaaccaaaacaatcttggacgaaaagctgcagcaagacacgctgcaaaaagccaaaatcctgtgttgtgatggaatcgaaggcatcgattacagcggtgtgtacatcataaaaaacaaagggtcgcaaaaagtgttggacatttcgtcagcgtccaaagacaatggcgtaaatgtgcagcagtgggattacaatggtggcgaccatcaaaaatgggaattggaaaaaatggccgatggttattacaaaatcaaagccgtgcattccggcaagctattaaccgtatccggtgccagcaattccgatggtgcaaatgtggagcaatgggaagacatcggcggtgaccaccaaaagtggaaaatcgagaaaaacagtgacggcacattaaagctaatcgccaagcattctggccagctgctggatttaaaaagttccatccaaaataatggtgccaacatccagcaatggcctgataatggaactgatgcgcaatgttgggaattaacgaagctaaagcaccaccaccaccaccactaataanngaattc

SEQ ID NO: 4373 - DNA, 1352 bp, Artificial Sequence
  Optimized for E.coli
ccatggcgaccgctgacgacattcgtctgaacgaagttgtgaccacaggctctaccaacgactcaattgaactgcacaacaaaggcgccggtacagtggacctgtctggttggattctgaaagactcaaacagcagttctaaatacaccattggttctggtaccacactggctccgggtggctttcgtgcttttgacgtgcacgacgcatttggcctgggttcaagcgacaaagcgcgcctgtacctggctgacggcagtacactggttgacagtttttcttggagttctcactcaagcgcttcatggagccgctgtccggacggcagtggttcttttggtcaggcagcaaccctgacactgggtgctgctaacaactgtggtggcggtggcggtggcggtgttaccccgtctgcatggccgggtagttctacagttaccacagcagacgccagtaacgtgtttggtagtgacctgtctggcctgcaccaggaaggcggtgtgctgtgggcagcccagaacagcggcaaactgtggcgtctggtttcaaacggtagcggcggttggcagccagacacagcaagtggttggtctgccggcaaaaccctgcgctttacaggcggtagcggcgctccggacagtgaaggtgttaccgttaccggtgctggttcaggttctgctggcggtgtttttgtggcctctgaacgtaacggtgacgcgtcaggcaccagccgtctgagtgttctgcgctacgacgtgaccggtacaaactctaccctgtcagcgacacgcgaatggaacctgacatcaaacctgccgagcgtgggtagtaacgcgggctttgaagctattacctggattccggacagcgcactgacaagtgccggctttaaagacgaaagcaccggtgcggcttacgacccgagtcgttacaccgcccacaccggtggtgttttctttgttggtgtggaaggtaccggctctctgtacggctacgttctgaccgacacaggtgcatacacacgcgtggcctcactgtcaagcggtatggcgggcgttatggaactgcagtgggaaccgcagacctctcgtctgtggctggtgtgtgacgacaactgctcaggccagcaccgcacaatgaaaattgacaccaccggtgcgtttgctaccacagcagcctacaaccgtccgggcggtatgagtaacctgaacaacgaaggttttgcactggccggcgaatgtgttgcgggtgctaaaagcgttgtgtggtcagacgacggtaacaccggcggtcacgcactgcgtgctggtacaattggctgccaccaccaccaccaccactaataagaattc

SEQ ID NO: 4374 - DNA, 1664 bp, Artificial Sequence
  Optimized for E.coli
ccatgggtcagtcaaaaaccggcaacccgcaggccgaaaacctgcgtgaaagcctgacacgcggtgttgctaaaccggcagccggtggcgaagctgctccaagcagtaccggcgctgttagtgtgacactggctaacccggcataccgtgttaagaaaaccgcatctacaccggaagccaccgcgcgtgactttctggcaacacaggctcgtcagctgggtctggacgctacagcactggcaggcctggaactggtttcacagcgccaggacccggactttacagttgttcgcctgcgccaggttgcagctggtctgccagtgtacggcagcgaaattgccgtgaccattggtaaagacggcagtgttctgtacgtggcttctaacgcaattggtggcgttgccccgaaagcgtcaaaaacgcaggctgtggaccagcagcaggcactggaccgtgcgcgcagctacctgggtattggcgaactgcgtaacgcggaagctcagctggttgcttttcgcgacgcggctggtacccacacagcatggaaagttcgcggtcgcccggacggtggcccaaaaggcgactgggaactgctgattgacgctaccagtggtgaagttctgcgtgcagaagacaaagctttttacgcaacagacggttctggctacgtgtttcgcccggacccgctgtcttcaaccaaaagcagttacggttcaacaggctacaaagacaacaacgacgctgactctgctcagctgacagcagcacgtgttcgtgtgacactgaaagacctgaaacagtcaggtgccagctacagtctgtctggcccgtttgcgagctgtattgactttgacgccccgcgtgacaacgcttgcccagttcagccaagcccagcctttgaatttacccgcggtaacctgtactttgaagctgttaacgcatactaccacattgacacctttctgcgttacgtgaaccagacactgggcattaaagcactgccgtaccagtacaccggtggcgttcagtacgacccgcacggtgaaagcggcgacgacaactcttcatacagcagttcttcaggtcgcctgacatttggtcagggtggcgtggacgacgctgaagacgcggacgttgtgattcacgaactgggtcacggcattcacgactgggttaccaacggtggcctgtcacagagcgaaggtctgagtgaaggtgtgggcgactacctggcggctggctactctcgtgactttaaccagtggagtccgtctgacgctcagtacaactgggtgtacaactgggacggtcacaacgaattttggccgggccgcgttaccaactacaacgtgggtcgtacatacgcgcagattcgcagcagtgaaattcacaccgctggccagtactgggcaagttgtaacctggttgctcgtgacgcaattggtggccaggctatggacaaagcatttctgaaaggtctgtcaatgaccaacggcagcacaaaccagaaagcagccgcgcaggccgtgattaccgctgcatctgcgctgggttactcttcaacacagattaacgcaattgccaacgcgtacaacaaaagttgcacctacgccgttacagtgccgcagaaatctcaccaccaccaccaccactaataagaattc

SEQ ID NO: 4375 - DNA, 230 bp, Artificial Sequence
  Optimized for E.coli
ccatggcacagctggttaccggtgaccagacacagaacctgcagccggcaggcaccgtgacaattagcggtacagctggcagtccgatggactaccgtgctgaactgtctcagaaagctgacgaacagggtgcaagcgcctacaaagttattgaagcgcgcaccggcgacaactaccacattacagctcagctgtacaaacaccaccaccaccaccactaataagaattc

SEQ ID NO: 4376 - DNA, 872 bp, Artificial Sequence
  Optimized for E.coli
ccatggaagttaaactggttgtggactttgaagcttacgaaaacggtcagacaatggcaaaactgctggaagaactggcagccaaaccggaaagcgccgaagtgacagacctgattattggcgactggggtggcgcgtacgaaagcagtccggacgactttattccggttctggtgaaactgaaagaccactttccgaaactgcgtaaactgtttattggtgacatggaatacgacgaatgtgaagttagctggattaaccagaccaacctgagtccgctgctggaagcttttccggcactggaatcttttcacattaaaggcagccaggacctgagtctggaaccgctgcgtcacaacaacctgcaggaactggtgattatttgcggtggcctgccggtttcagtgctgcagcagattcacaacgcggaactgccggaactgcgcaaactggaactgtacctgggtgttgacaactacggttttgacggcaacctgaaagacgtgctgccgtttctgaactctaacccgtttccgaaactgacctacctgggtctgaaagactcagaaattcaggacgaaattgccattgcggctgcaaacgcgccggttattggccagctggaagtgctggacctgtctcagggtacactgtcagacaaaggcgccgaagcgctgctggcttctgaatcaattaaaggtctgaaacacctggacctgagctaccactacatgtcttcagaaatgatgcagcgttggaaaagcagtggcctgagtgttaacgtggaagaccagcaggaagcagacgaagaagacgactggcgctacccgagcctgacagaacaccaccaccaccaccactaataagaattc

SEQ ID NO: 4377 - DNA, 1649 bp, Artificial Sequence
  Optimized for E.coli
ccatggacatgaacccgaccgaagaacgcctgtttctgctgctgaaaagcaaaccgagttttatgcgtgcaatgccggccggtcgtgaaatgcgcgaactggtgtttaaaggtcgtgcagttccaggtccactggaatggggtgaaagtccgaccgaaattggcattaaaccgattggtctggttacacacgtggcacgtaactgttctaacgacaccgttggtgtgattagcgacacatttaaagccagttacgaacagacccagtcttgggaagttacagtgggcaccgaactgacaaactcagttgaagtgacagcaagcctgccgggcgttgtggaaaccacagcgggtaccgctgttacactgaaatttgaaggttcaaaaggtggcgaaaccaaatctacaaaatcacacgacgccggttacagcattccggtgaaaccgggccgcgaactggacgttcagtttcagattaccgaacaagtgattgaaggtacaccgttttcaattgaaatggaactgctgggcaaagttgaaattacacacccgccgcagggtaactgggtgcgttaccgcggtagtgtgccggcgaaagctgtttctgccggcaaagaatggaacgcagccggtacaaaacgtcgcgacctgtgggtttgtcgtgcggctggtagcccgcacattggtaaagtgattggccgtcgctgcaactacggctacggtggccaggaaaaaaccacaaccaactttgacgttctggttgtggcgggcctggaaaccaactgggtgggtaaatctcagtttgaatcaggcgacgactacgacgaagacattgtggcagagggtaaagcagaagtgttttacggtggccaagaaagtcgcccgaccaaacgttacaaaggctggacatttgtttgtcgcgctaaacacaaaggcgactttcacccgggtaaagttgtgacaaacgactgcatgattggttacggtggcaaagaactgcagaaaggccgctacgaagtgctgatgcgtggtaaagaagttggcgacgtgaccccggttgacctgcaggaccacctgccggacgcagcagaacgtacatttgttgtggaaggtgtttttgaagacgcgcgttcatttggcgctacaaccgtgtttggtaccagccgcccggtgaaccgtacagtttgcccgggttacgttccgccgcagaacgacacctcaattcgcgacgttgaagtgcgtaccagcgaaccggtgacatacagcggcgacagtgttgccattccggcggcttacaacgacagccgcgaacagccgaaagaaccgaaagcacagggcgaaccggccattaacggtaccgttctggcgaaaattagttacggtgaaaacggcgaagcacgtgccacactggtgtctcgtattctgcgcgacctgcgtgctgacatgtttggtgcggacgttgtggctgttcagcaggcactgaacgacgctggtgcagcactgcaggtggacggttactttggcgcgaaaaccgcgcgcgctctgcgtgaatttcagcgtgctcagggtctgagtgtggacggtgtttttggcccgcagtctcagaacgcgctgggcctgcaccaccaccaccaccactaataagaattc

SEQ ID NO: 4378 - DNA, 314 bp, Artificial Sequence
  Optimized for E.coli
ccatgggtgacattaccctgtacacacgtgcgcactttggtggcccagctctgcagctgcacggtagcgaaccggacctggacaaactgggctttaacgaccgcaccagcagtgttattgtgcagaacggcacatgggaagtttgtgaaaacaaacactacaagggtaaatgcctgattctggaaaaaggcgaatacgcagaactgaaaaactttaacgacatgatgtcttcagtgcgtgaaattgaagcacgtccggcagccaaagacaaaccggaacacaaacaccaccaccaccaccactaataagaattc

SEQ ID NO: 4379 - DNA, 1520 bp, Artificial Sequence
  Optimized for E.coli
ccatgggtcagctgattctgaaaaacaccagcctgagtccgattacctgtacagttgacggttggacagtgagcagtggctcttcatttgactggtttattaaagtgcagccgggtcagagctttttcgttggccagaacacctctcgtccgaaagacccggtgattaactgggcaaaatgcaacaacctgcagacacgcgccatgaccattacaccgagtggcccgaaccagaccctggttctgaacggtcagcagacacaggttctgaacgtgtctctgtacccgtttctgccgaccctgccgacagacaactttgaaaacctggttgcatacattgtgcagacctaccagtcacagcacccgcaggttctgctgaacgccgtgctgaacccgcaggttaacatttacagctttacagaactgccggtgctgctgggtaacgacggctttgacgtgattgaactggacgttctgtacctgggctttctggcggacaaccacctgattaacccggcacagattaccggtgaagcaccgtgggcagttgcactggctggtgctacataccagggccagctgtgggctattccgagttggctgtgtatggactttttctacgcatttgaccaggccattcagcagcagaaaaccctgtctaaaatgctgaactacctgaacacccgtacaagcagtgtggcgaaaatggctggttcttttaacggctcatgggcgattccgagtgactacattaacgcttacgttcagacctacggttacggcgcgctgcagcaggctatgcagatgcctccggacaacggcgttgtgcaccagctggtgtctctgtcagacacatgtagctttaacggtgttaacaaatgcaccaacaacacataccacaacgcgccgaacggtggcgctgaacaggtgtttgcaagcggtcaggccagtaccgacatgggcttttctgaacagtcattttacgttaacctgtactcttcagcacagaaaccgctgtacgttgttccaaccccgtggggtgaacacccgcagccgctgctgtttgaagacgcctttgtgagcagtgcagccacatgtaaaccgggctcacagtgcgcggctaacgcacaggcctttaccacactgatgaccggcacagccatgaaaaactacattgttcagagcaaagacctgccggctggtaccccgtggcgtacactgctggttgctacccagcagttttggcagcagtctattattgcaaacaactcatactaccagcagctgagcccgatttttatgaccgcgaaagcttttccgaacaactttacaccgcagagccaggtggcaatggccaacggcatttgtaacgcgctgaaacagcagcagccgaactttgtttgcaaatcaaacaacagcaccagtctgctggctccgagccacggttcttcaattattaacccgggcagcacagacagtcgtcgcggtctgcaccaccaccaccaccactaataagaattc

SEQ ID NO: 4380 - DNA, 2087 bp, Artificial Sequence
  Optimized for E.coli
ccatggaaagtcacgtggacaacccgtaccagggtgcgaccaaatacatttctccggactacgcagcctcagttgacaccagcattgctaaaattacagacgcgaacctgaaagctaaaatgcagaccgtgaaaacatttccgaccgcagtttggctggaccgtattgcggctattaacggtggcggtggcaaactgggtctggaagcgcacctggaccaggtgctggctcagaagaaaggtagtacaccgattaccgcagaatttattgtttacgacctgccgggtcgtgactgtcacgcactggcatctaacggtgaactgccactgacccaggctggcctggaaacatacaagaaagactacatcgacaaaattgcagccatttttgcaaacccgaaatacaaagacattcgtattgtggccattattgaaccggactcactgccgaacctggttaccaacctggacgacccgaaatgcgcgcaggctaaaagcaccggtatttacgaagcgggcgtgaaatacacaatgaacaaactgaacgaaatcccgaacgtttacaaatacgtggacattggccacagtggttggctgggctgggacaacaaccgcagtgctaccgtgtctctgttcaccacaatcttcaaagacacatcaaaaggtctggcgagcgttgacggctttattaccaacacagctaacacatctccgctgacagaaccaaacctgccggacccaaacctgaacattggtggccagccgattaaaagcagtaaatactacgaatggaacccgaactttgacgaatcagactttgcagaagccctgcaccgcgactttgtgagcgcgggttggccgtcttcactgggcatgctgattgacacaggtcgtaacggttggggtggcccaaaccgtccaacatctgctgttggtaacgacattaactcatacgttaacagcggtcgtgtggacaaacgtagtcaccgcggcaactggtgtaacaactctggtgccggcatgggtacaccgccgcagacagctccagctggccacattgacgcatacgtttgggccaaaccgccgggtgactcagacggcagcagttctctgattccgaacgacgaaggcaaaggttttgaccgtatgtgcgacccgacctacaccacaaaagacggtaccctgacagacgctctgccaaacgctccaatttctggtgcatggtttcacgaccagtttgttatgctggtgcagaacgcatacccggccattgttccatcaaccggtggcgttgacccggcaccaacagctccggctgtgccatctggtctgaaagctgttgtgggcaacgctcaggttaccctgacatggaacgcaagtaccggtgccgactcttacacagtgaaacgtgcgaccagtgaagctggcccgtttacagcggttgctccgctggtgacagaacgcgaatacaccgacaaaggtctgacaaacggcaccacatacttttacgttgtgagtgcgaccaacgctaaaggtacatcaaaagacagcgcggctgtttctgccgaaccgaaaggtaccccgacagacccgacggacccgacagacccaacagacccaacagaaccagcaggtgacctggttgttatgtaccgtgctggtgacacagacccagcaaacaacgccgtgaaaccgtttttcaacctgaaaaacaaaggtaccacaccggttaaactgagcgaactgaaaattcgttactactttaccaaagacggttcacaggaactgcagagcgcagttgactacgcccaagtgggcaacgacaacgttctgcgcaccttcacagacaactacatcgaaatcggtttctcaccagcagctggtaccctggctgctggtgctcagacaggcgacattcagattcgtatgaacaacagtgactggtctaacctggacgaaagtaacgactactcttttgacccgaccaaaacaagctacgcagaatggaacaaagccaccctgtttcacaacgacaaactggtgtggggtattgaaccgcaccaccaccaccaccactaataagaattc

SEQ ID NO: 4381 - DNA, 236 bp, Artificial Sequence
  Optimized for E.coli
ccatggacaaatttacacgtcgcaccacaaccctgtctgactcagactttagccaggcagttagcagtgaaacacaggccccgattgaaggtaccgaagacctgagctgtccgtgggcgccgagtgtgtgtaaccgtcactgcctgagccacggttaccgcggtggctactgtgcaggtccgattaaactggtttgtcactgctaccaccaccaccaccaccactaataagaattc

SEQ ID NO: 4382 - DNA, 1232 bp, Artificial Sequence
  Optimized for E.coli
ccatgggctacattcacattccgaaacagattgtgctgttcgaacagcagaaagaaaaaatcaacaccacactgccgctgagcgttgaagcgagcagtccggtgtacgacgttaccagtaacaaagcaaaactgacagtggccggcaaacaggttggtaaagaagaactgatgctgcacctggctggtattccggtgaaacgtgttgacgtgcaggttctgtctgactttaaagttattccgggtggccagagcattggtgtgaaactgaacagtaaaggtgttctggttgtgggctaccaccaggtggacaccgcgaaaggtaaaaaatctccgggcgaaattgctggtattcaggttggcgacatgattaccaaaatcaacggtaaaacaatcgaaaaaatgagtgacatcaccccgtttattcagcaggcaggtaaaacaggcgaaccgctgaacctgcacattctgcgcgagaaaaaacagtttgacaccaaactgtacccgctgaaagacaaacaggactacgcataccgtattggtctgtacattcgcgactcagcagccggtattggcaccatgacattttacgacccgaaatctaaaaaatacggtgccctgggccacgtgatttcagacatggacaccaaaaaaccgattgttgtggaagacggccagattgtgcgttctaccgttacatcaattgaaaaaggttctaacggcgttccgggtgaaaaactggcccgtttttcagaagaccgccagattattggtaacattacccgcaactctccgtttggcatttttggtaaactgtcttcaacaatggaaaacggtattatggacaaagcgatgccgattgctctgtcacaccaggtgaaagaaggcccggcgaaaattctgaccgttgtggacgacgaccaggttgaagaatttgacatcgaaatcatgagcaccattccgcagaaatttccggctacaaaaggcatggtgattaaaattaccgacccgaaactgctgaagaaaaccggtggtattgttcagggcatgagcggtagtccgattattcagaacggtaaagttgtgggcgcagtgacccacgtgtttgttaacgacccgacaagcggttacggcgttcacattgaatggatgctgaacgaagcaggtatcgacatctacaaaaacaaccgtaagaaagcaagtcaccaccaccaccaccactaataagaattc

SEQ ID NO: 4383 - DNA, 689 bp, Artificial Sequence
  Optimized for E.coli
ccatgggcattgacgtgaccgtttggtctgtgacactgccggttcagaccccggcacaggttgtggcaacaaaagccatgccgagcctgaacaacaaatactttgacaacaacggtcagcgcattatcttttgggcaccagtgacaggtagccacacaggcaacagtgactacccgcgttctgaactgcgcgaaacctcacgtgacggcaaacaccgtaactggcgctacaacagcggtattaacacactgaaaggcgaactgaccgtgaaccaggttccgagtgaaggtcgtgttgtggttgcgcagattcacgcgaaaaacgctccgacaccgctgctgaaactggtgtaccgctttgaaaaaggtaccggcaacattgacgtggaataccgtgttaaaccgaaagacaaaaaatctccggttatttacacagtgccgaaagttccgctgaacaaaagctttagttacaccctgcagatggacaaacagggccagctgagtgtgctgattggtaaaaacggcaaacaggttaaactggacaaatcttggcacggttacgacttttactttaaagccggcgtttacacactggacaacaaaggttacagcaacgaaggtggcaaagtgacctacacaaaactgtctgtttcacacaaacaccaccaccaccaccactaataagaattc

SEQ ID NO: 4384 - DNA, 833 bp, Artificial Sequence
  Optimized for E.coli
ccatggtgggtagctacattcagaacggccgcattgacctgatggcgctgctggtttttagcctggttgtgggttttgtgggcagctttattagtctgggtatgagtcgctggatggctaaaaccatgatgggcgttcgtgtgctgaacccgaaaaaacagagcctgagttacgaagaacagcagctggttgaccgcgtgcaccgtctgtctcgtgcagctggtatgaccaaaatgccggaagttggcatttaccactcaccggaagtgaacgcgtttgctacaggtccgtctaaacgtcgctcactggttgcagtgagcagtggtctgctgcagcagatggacgacgcggctgttgaaggcgtgctggcgcacgaagttgctcacattaccaacggtgacatggtgaccatgacactgctgcagggcattgttaacacatttgttgtgtttctgtctcgcattgcagcctgggttgcctcacgttttgtgaaagaagacctggcaccggttgtgcacttcatcgccatgatcgttttccagatcatttttagcatcctgggtagtctggttgtgtttgcgtacagccgtcaccgcgaatttcacgctgaccgcggtggcgcagacctggctggtaaagacaaaatgattcacgcactgcgtaccctgaaatcttactcaggccacgttaacgaagaagaccagaccgccgtgcagacactgaaaattaacggcaaaaaacactcttcactgtttagtacacacccggacctggacgaacgtattcgtcgcctggaagcaaaacaccaccaccaccaccactaataagaattc

SEQ ID NO: 4385 - DNA, 725 bp, Artificial Sequence
  Optimized for E.coli
ccatgggcaaacagattattgcgatgggtggcggtggcttttctatggaaccggaccacctggttctggaccagtttattattaaccagtctaaacagccgtcaccgcgtatttgttttctgccgaccgcgtcaggtgacgctgaaaactacgtgcagcgcttttaccacgcgtttcagaaactggactgcgacccgagccacctgagtctgtttaaaccgccgaccacagacctggctagcttcatcatggaaaaagacgttatctacgtgggtggcggtaacacacgtaacctgctggttctgtggaaagaatggggcctggaccacattctgaagaaagcatgggaaaacggtattattctggccggcctgagcgcaggtgccatttgttggtttgaagaaggcgtgacagacagtgctggtccactgacaggtctgaaaagcctgggctttctgcagggtagtttttgcccgcactacgacggtgaaaaagaccgtcgcccggcttaccaccacatgattagcgcgaaagctctgtcttctggttacgcagctgacgacggtgctgctctgcactttattgacgaccagtttttccaggcagtttcttcacgcagtgacgcaaacgcctaccaggttgtgctgcacgaaaacgaaatttctgaaattgccctgccgattacctacctgtcacaccaccaccaccaccactaataagaattc

SEQ ID NO: 4386 - DNA, 2240 bp, Artificial Sequence
  Optimized for E.coli
ccatggcttgtacatacagtatgacctacattcagaaagttaaagcaggtggcacctacgacattggtacactggttgtgaccgttgacccggtgagtgctgaagcgtctgtgggccgctacgttgtgctgtcactgccgggttcaccgagcggctacgaactgtttccgggtctgagcgaaaacgaaattgcagccaaaattaccggtacaaactactttaacacagcaaacggcgccacctttaaagttgaacgtctgtcagctcgtgaagttcgcctgtgggtgggcagcattgctacagcaggtattgcgccgggcgacgactctcgcattctgattccgctgcgtattaccgttccgtcaggtgtgagcggcgacattattctgacagtttcagctccgagtacctctgcatttctgaacggtagcctggtgattgctcgtgctgacgctaacctgccggactgggtttttgccgtgtacatggcggctgacaacgacctgtcacgctttgcactggccgacctgcgtgaaatgctgagcgtgccaggcctgggtggcaacgttgtggttgtgctgctggacctgccgggttcagaaaacgacggcgtttacctggtgcagcgtggtacactgcagccagttccaggttggccgcagggtcaggaactgaacacaggcgacccgagcctgctggcagcctttctggactttgtgcgcaacaaatttccggcgggtcgttacgctctgattctgtgggaccacggtgctggttggcgtaaactgcagccacgtggcgtttgttttgacgacctgagtcgcgactttctgatggtgccggaactgcgccaggcactggtgcgcgcacgtgtgccactggacctggttggttttgacgcctgctttatgggcatggttgaagtggcgtacgaactggaaggtctggccagtgttatggtggcgtctgaagaaggcgaaccaggtgacggttggccatacgacaaaattctgacatggctggttgcgaacgctagtaccgcggacggtaaagctctgggccgcgcaattgtgtctgcctacacacaggcgtaccagggttacggcgctctgaccatgagtgcaattgacctgggttgtattaaagacgttcgcgaaaaaacagactctctggcagtggccctgctgcgtaactttgacagtgacaaaacccagatttctcaggctgttcagaacgcacgtagttaccaccgcgaagaatttcgtgacctgtacgactacgcgtcactgctgaccagctactgcagcagttctgttgaaattcgcgcggctgcacaggacctgcagaaatctattgaacgtgcggtgctggctaacggtaccacacagtacgacgaccgtagtcgcggcctgtctatttggctgccgccggaatcacaggcatacctggaactgctgagctactacggtgttgactttgcctcaatgtttaactggtacagcaacctgcgctttgcgaaagaatcacgttggggccactttatcaaaaaatggattctggacgaaagtacaccgattgcgaccgcttttggtgtggaatcaaccgacccggcagacggtgcaacagacgttccagtggacaaaaccattacactgacctacaacacaccggttcgtccgggtccggcatacggcaaaattgccctgctggacgcgtcaggtcgcaaagtgagcattcgtaaaaaactggccggcacagtttttaccattgacccggtgaaaaacctgagctacggtaccacatacaccctggttctgccagcaggtgctgtgaaagacggtgcaggcaacctgagtgaagaatttgttctgtcttttacaaccgaaccgccggacgtgacaccgccggctgttgtggaaaccgacccgccggcaggtggcgttgtggacagtctgaaaccggttctgaaagtgcgcttttctgaacaggtttacaccggtcgcaactacagtcgtattgctatttacgacgaatctggtcgtcgcgttgcagtgtcaaaacgcattagcggcgacctgctggaagttcgtccggtgggtgcactgaaaccgggtatggcttaccgtctgtacctgccggctggtgctgtgaaagacaaagccggcaacctgagcgaagaatttgaactggtttttgtggcgccgggtccgcaccaccaccaccaccactaataagaattc

SEQ ID NO: 4387 - DNA, 1466 bp, Artificial Sequence
  Optimized for E.coli
ccatggacggtcgcaccacacactaccgtgttattcagctgggtgcgccgaaaggcgcaggtggtgttcagagcaacgaagttgtgagcgactttgacagtctggttacccaccacccgggtaacaaccgtaacgctcacctggaaaacggcctggttgtgggtggcgaacgtacccgtcagcacgcactgattggtggcgaaattcaggaaattgaaattgttcgtaacggtaacacatttcagggcctgaaaccggaccaggtgctgctgaagaaagactttatgctggaagcaccgggtcaggcaaacccgcgccaggttgacgttccgagcccagtggccggtgttgtgggtcgcgttagtcacgcggaaggcctggtggacattcacgaccgtcagggtggcgacgttattgctcgcgtgcgtcacatgcgcgacattgaactggaagttaacgacgcggtggcttacggtcagagtctgggcacccagcaccgcgttgccacagaaaaagttcacgtgcacatggaagtggacacccgctactaccgtcagtttgaaaactacgttggtgacctgacagaaggccgtctgccagtggaagcagctgctcgtctgggtgttgaaccacgtgcagttgctgacgacggtgttctgcgtctgggtgaaagcagtctgcgcattcgtgacctgcagaaccacctgaacggtatgggctacgttggtgctgacggtcaggcactgacagctgacggtgtttaccgcctgaacatgcagcgtgcggtgctggactaccagcgtgaacagtgtctgccgcagaccggcgacatttctcgcgaaatgctgcaggctgtgccagctcgtacaccgggtccatttgacccggctctgggtggcattccggctccaggcctgccgtacgcaccaatgccacacccatttggtacaggtgcagacgaccgtccatgtgcaccgccgacactgcagcagattgaagacgctgcagaacgtcgccgtccgtgggacccggcattttctgccgcaccgccgtcaatttcttcagacccgctggtgcagtcaattcgcgaacgtctgccgcaggcgtttgctacctacggtgctgcaccgccggaagttgaactggaccgtattgcgacaggtctggctgtggaatgtcgcaaacagggcattgaacgtccggaccacattgcagttggtaacccagcaacagacggttctggtcgtcacgtgtttgctgttgttggcgacctgcgcgacccggcaagtcaccgcgttgacgtggctgctcacgctgcagcacaggttccggtggaagcctctctgctgaaactggacgcactgcaggcctcaacaccggctctggttcagggcgaccaggctcaggaactgcagaaagcaccgagcatgcgtgtgcaccaccaccaccaccactaataagaattc

SEQ ID NO: 4388 - DNA, 596 bp, Artificial Sequence
  Optimized for E.coli
ccatgggtcacggctacgttgacgctccgaaaagccgtgcatttatgtgtaaagcccaggaaaacaccgcatgcggcgccattcagtacgaaccgcagtctgtggaaggtgcaaaaggttttccagacgctggtccggctgacggtgcaattgcagccggtggcctggcacagtttgcggaactgaacgaacagaccccgacacgctggaagaaagttgcgctgaccacaggtgctaacgactttaactggtactttaccgcaggccacatgacacaggactggcgttactacattaccaaacagggctggaacccgagccagaaactgagtcgcgaagcctttgacctgcagccgttttgtgttattaaaggtggctttgcgccgggtagcaacacacacgctaaacaccgttgcaacattccggcggaccgctctggttaccacgtgattctgtcaacctggaacattgcagacacaggcaacgccttttaccaggttattgacgctcagattcaggcgggtgctacaatgaacccgcagaaagtgattattaacccgtttaaacaccaccaccaccaccactaataagaattc

SEQ ID NO: 4389 - DNA, 704 bp, Artificial Sequence
  Optimized for E.coli
ccatgggtccgacctcttacatggactacacaaaaccgggcgttgcatttttcagcgacgtgaacaaaaaccgtctgtttacccgcaacgacgaaaactacattaaccagctgggtcgtaacgaactgaacacactgggcaacgtttctatgctggacatttacctgtcaaacggtcgcgttgtggaaccgcactaccaccagaacgcaagcgaactggtgtactgtattagcggcagtgccgttgtgagcctgattaacccgtttaacaacgaagttagtaacattccgattaccccgggtcaggtggcgaacattccgcagggttggtggcactgggaagaagctaccaacaacaacacacacctgtttgcgatttttgacgctccgtacccggaatacattctgggttctgacattctgaccaaaacaccggttgaaattatggcacacacctactgtctggacccggaaacatggaaagaagcaattgccccgattaacgaaagcgtgattattggtccgaccgacgaatgcacacgtgaacgcgaagaccaccagggctacagtcagccgtactacccggaaaccaacacaaactacccgtacacagttccgcagtacggctacatgcagccgtacccgaactactactacctgggttacggctaccagcaccaccaccaccaccactaataagaattc

SEQ ID NO: 4390 - DNA, 587 bp, Artificial Sequence
  Optimized for E.coli
ccatgggtagcctgctgaacaccaagaaaaccaaacacgaagaagcaaaactgctgacccacattaaccacgacaccgacacatcttttagcagtctgtcagcggacgaagacaaaaagaaaattaaaccgattcgtctgtctgctaacacagaaaagaaagaaaacgaacagtcagaaaaaaccaacgaaaagaaagaaacctacagcgaaagtgaaaaagaactgctgtctcgcctggttcacgcagaagccaagggtgaatcttacgaaggcaaagttgcggtggcttcagttgtgctgaaccgtaccgacaaaaacggttttccggacacaattcgcggcgttatttaccagaaaaacgcgtttgaaccggtggctaacggtagcattaaccaggaaccggacaaagaaagtattgaagcagttgaagaagccatgtcttcaaaagaccgtgaaaccgaagcactgtttttctacaacccgaaaacagccagcgacgactggatccgtagtcgcaaaatcatcgaaaaaatcggccgccacgtgtttgccattcaccaccaccaccaccactaataagaattc

SEQ ID NO: 4391 - DNA, 986 bp, Artificial Sequence
  Optimized for E.coli
ccatggcgccggcttttgcaaaaggcgcagacattagttgggttgccggtatggaagcgcagggcatgacctggaaagacaagaaaggtgttcgtcgcgacattctgcagattctgcgtgacgactaccagattaactcagttcgtattcgcgtttgggtgaacccggacatgaaagactacgctagcggttacatgaacgcagaaaaagcagccgaactggcccagcgtgcgaaaaaactgggcatgtctgttatgctgacactgcactactcagacagctgggctgacccgggtcagcagaacaaaccgtacgcatggcgcaactttacctttacacagctgatggacgctgtgtggagtcacaccgtttacgtgatgaacacaatgaaatctaaaggcgttaccccggactgggtgcagattggtaacgaaacaaacaacggcatgctgtgggaagacggtaaagcctcagttaacatgaaaaactacgcgtggctggtgaacaccggtaacaacgccgttaaaagtgtgagcagttctaccaaaacaattgttcacctggcgaacggcgacaacggttctgtgctgaactggaacattggtggcctgattgacaacggcgcccagtttgacctgattggtctgtcactgtacccgagtccgtctgactggcagggcaaagttgaccagaccattacaaacgccaacaacctgattgcgaaatacggcaaaggtattgtgattagcgaaattggtatggaatacaacgaaccggcggcttcaaaagctttcatcagcgcaatcaaaaccaaagttcgcaacattggtggcggtaaaggcaccggtgtgttttactgggaaccggcagccacaccgggctacaaccagggttacaacaaaggcgcttggcaggcagacggcaaaccgacaagcgcactggaaggttttattaaccaccaccaccaccaccactaataagaattc

SEQ ID NO: 4392 - DNA, 887 bp, Artificial Sequence
  Optimized for E.coli
ccatgggtctgcagtttctggacaaacgttacattgcagccattattattgacgcctggcagtctaacctgaacacagaaatggacccggcggacggccagtggtttaccaacggcccggacaacaacggtggcctgtacggctacctggtggacaaaattgctacaaaactggtttttgaccagtcacagaaagtttttgaagtgcaccagaaagcggctgtgaccggtattgctgacaaccgcaacggcctgacaccgaacatgaccgtttctctgaaatacgcataccagaacagcagtaccacatcacacacaaaaagtcactctattaaagtgggtaccggcgttgacattaaaagcaaagccgaatttctgggttgtggtggcgaagtgaccttcaaattcagtttcgaatactcacacagctggagtgacaccacatctacatcaaaaaccgaaacactggaattttctgacaccgttccgatttcaattccggttggtcacgtgatgaaagttctgctgatgtgcaacgaacagcagctggaagtgccgtactttgccgacattcacctgagcggcaacagtaccacaaactttcgtagcccggttaacggtaagaaaatttggagtacagacgcgggcaccctgtgtcagtggattagccagtacaaatcttcaagcgacgacaacctgatcttttgtcgtgacccggacgacccgaccaaaggtctgattcgcgtgaaaggcatgctgaccgctacacagaccgtgaactttcacgttgcaacagaagacattaccaaaagttttgacggttacattccggaaggcattgcacaggccgttgcggtgcaccaccaccaccaccactaataagaattc

SEQ ID NO: 4393 - DNA, 512 bp, Artificial Sequence
  Optimized for E.coli
ccatgggtaaaggcgacaagaaaattattgctcacctgaacaaactgctgggtaacgaactggttgctattaaccagtactttctgcacgcacgtatgtttaaaaactggggcctgatgcgcctgaacgacaaagaataccacgaatctattgacgaaatgaaacacgcagaccgttacattgaacgcattctgtttctggaaggtctgccgaacctgcaggacctgggtaaactgaacattggcgaagacattgaagaaatgctgcgttctgacctggcactggaactggacggtgctaaaaacctgcgcgaagcaattgcctacgcggacagcattcacgactacgttagtcgtgacctgatgattgaaattctggccgacgaagaaggtcacattgactggctggaaaccgaactggacctgattgcgcgtctgggcattcagaactacgctcaggcacaggtgctggaacgcaaagaccaccaccaccaccaccactaataagaattc

SEQ ID NO: 4394 - DNA, 290 bp, Artificial Sequence
  Optimized for E.coli
ccatgggtattgaccacattccgtgtcgtgcaggcgaaaactttctgaaaatttggagccacctggacggtcgcgacagcgttgactgctacgccaaccgtggtcgcattggctttggtggttggtgggtggacaaaattgaaaccggtaacaacgacctgatttacagcgacgcaaacggcgacagtgttcgtgtgaaccgctggaccattattacatacccgaaccgtccgccgcgcgttaactacattgaaattctgcaccaccaccaccaccactaataagaattc

SEQ ID NO: 4395 - DNA, 131 bp, Artificial Sequence
  Optimized for E.coli
ccatggcaaacaaacagcagaaaagccagccgaaaaacaaaccggaaaccaaaacatacggtgacccgaaaaaactgaacggcccgaaccagccgagtacccaccaccaccaccaccactaataagaattc

SEQ ID NO: 4396 - DNA, 1001 bp, Artificial Sequence
  Optimized for E.coli
ccatgggtattggtgttggttaccgcgacccggctcacccgaagaaaggtgcagccgttattgtgtacaccgaccgtctggcttctgcatcaaccggtctgctgtctgccacagcgctgggtaagaaaaccaacgttccggtgcgcattgtgaaaacaggcaaaattcgtgctaacgcaaccgactacaaagttcgtattcgcccggtgattgccggctactcagttggtacaattgaaggcagcggtagtaccggtctgattgttgctccaacaggtgcaccagctacacgttacctgttttctaacaaccacgttctgaacccgtcaaacacagacaaccgtgaagctaccattcagccgggtggcgcagacggtggcacagttacacaggaccgcatgggtcgtctgtaccgctacgtgcgtctgaacccgacaggcattaacctgattgacgctgctctgagcctgccaacccgtaacaacctgctgaacccgcgttacgccacagttggcgcgattccgggtcacgtgaccgcctaccgcattggtgaacgtctgaagaaagttggccgcaccacaggtcgtgtgaacggcacagttgaaagtgtgtacaccgacctgcagattaactacggtggcgaactgggtctgctgacctttgaagaccagacagttattcgtggtacaacaccggtgagcctgccgggtgactctggttcagtttggctgcgtcagagtgacaactacgcagccgcggtgaactacgctggtaccgcagacggccgcctgagcattgcctttccggttcagtgggcgatgcaggtttttaacacccgtgtggctcgtccgaacggtgcaggtcgtgttctgcgtgtggacaccggtagcagtccgcgcagctacacccgtcagctgacaagtgaagaactggtgcgtctgcgcccgcgtaccacacgtattcgtcgcagccaccaccaccaccaccactaataagaattc

SEQ ID NO: 4397 - DNA, 815 bp, Artificial Sequence
  Optimized for E.coli
ccatggctacagctattccagacggttctgctcaggcagttacaggtgcagctgctccaacagctgcaccagtgctgctggctgctgacgaatttgacggtccagcaggtagtgctccaaacccagttatttggcgttacgacctgggtgctagcggttggggcaacgcagaactgcagacctacacagacagtcgtcgcaacgctgcactggacggtgctggtaacctggtgattacagctcaccgtgaagcagacggctcttacagcagtgcgcgcctgaaatctgaatcaacctacacagctcagtacggtcgtattgaagcacgtattcgcattccgcgcggtcagggcatttggccggccttttggatgctgggcgcggacattggtcaggttggctggccggcctgtggtgaaattgacgttatggaaaacgtgggttacgaaccgggcattgttcacggtaccgtgcacggtccgggctactctggtgctcagggcatttcagccgcgtacacaaacccgtctggcgctgcatttgcagacgactttcacgtttacggcgtggactggcgcccgggttcaattacctggacagttgacggcgtggcttaccgtaccgttacgcgtgctgacgtgggttctgctacctgggtttttgacaaaccgtttttcgtgattctgaacgttgctgtgggtggcaactggccaggtagcccggacgctagtacccgttttccgcagcagatgacaattgactggctgcgcgtgcaccagaacgcacaccaccaccaccaccactaataagaattc

SEQ ID NO: 4398 - DNA, 3803 bp, Artificial Sequence
  Optimized for E.coli
ccatggatcaaactattaccaaaatacgagcggcagtccattctttgttttccaatcataatttacaattgagtatcactgattatgacatagattatactgcatatcttgtggattgtatgtctagcgatatatgttcgcaagaaaagatggcattacttgatcaaatcaagtttgccaaacgtttgagccgaaaacgcaacttattaaatgacggagattttagattatccaattggtcagatgagaatggatggagaagaaatgctcatgtaattttcgcatcagactatcaaggacgatacgcaaacatgccagctgcgacaacagcggaaaatggaacaatcgtaccgacctatttgtatcaacaagtaagtgaatcaaagctaaaaccgtatacacaatatttggtacgaggggttgttgaaaacagccaagatttggaggtatttgtattacggtatgcgaaagaagtatccaaaaaaataaatatattaaatgataacagctaccccaatctattacatacgaatagagacgggcatcagtgctatgagaggtatccaaaacaaatcatgattcaaaattcgattgatagatataaaaaaccacatgaatttacatatcacattgatataggagaactgaatctaaacgaaggacctggcgtatgtgttggttttaaaattagaacgacagatgggatagcaacattagctaatatagaaatggtagaagtacagccgttaaagggagatgcgttagcacgtataaaaaagcgcgaacaaaaatggaaacaaaagtggattgagaaacgtatgaagattgaagaggcggtacaagtggcacaagatgctattcaacatttatttacatgtccacaacaaaatcgattgaaatggactacttccctgacggatattgaatatgcagagacactgatatctaagatcccatattcgtatgaccaactttctttgggggagttcccaatgttaccaagggaggcatatgacatccttcaacaactttcagcggcagtcacgaaagcacaagcgttgtatgcacaacgaaatatagtaagaaatggtaatttcagagatgaattatcaaattggaatgcgacaggtggcatagaagtacaaccgagtcagaacacaccatctatgttagtaataaaagattggagtgcaagtatttcacaagatgtgtgtgtgaatccagaacatagctatctcttacgtgtgaccgcaagaaaagaagggcttggaaaaggctatgtaacaatcagtgattgtatggaaaataatactgaaaccatgatatttgtatcagatgaagaaaagatggtatctactgaatcccttcgtgatacaactatagagagtgcgcgtataggagaaacgctagatacagggagtccaaatagaaattacccatcagagagctttggatttacgccatatgatgatcaaaatcaaatgatgaatcagtcacctaatcagtatgaaatgaatgtgtactcgaacaacgttaacacgacaaatggtcatgaattaggatgcggatgtcgtacaaatgctcactctagtgaatgtaagagcatgtatacatcatctaaccatgatgaaaggaacgcatatcttacaaacggaaatagcataactactaatgagacaatattgtcttcctctccaatcccagtacaaaacagctcattcctttctggctatgtaatgaaaacagtggaaatcttcccagaaaccaatcgtgtccgcatagaaatcggagaaacagaaggtacatttatagtgaacagtgtggaattgattcaaatagaacaaataaatgaaatgaacaatcaatctgtagatgttcaaaatgtagcttatgatacgaccattacacaatctaatcccgtttcttttacagaaatatcggcgagtcctaggcacactcattatgcatactctcatgattcaaatataggttatgaaaatcctaactggatggctgatattccagatgatactatgtttagtgatttatctatccctggtacacataatacaatggctctttatggaggagatgttacacaatgtcaaacgatgtcactgaatacacaattatatgcaggagttcgttacttagatatccgctgtaggcatatcgaaaatgtttttgcaattcatcatggacctgtgtatcaaaatgcgatgtttggagacgtttgtataatcgtaagggattttttgaggaaaaatcctagtgaaacagtatttatgcggataaaagaagagcatacaccggaaaacaatacaaggtctttttcggagacattcgcagattataagtctcaatatagcgaattattttggaattggtcaagtgataacccaaaattaagtggaataagaggaaaagttgttgttttgcaaaatttttctggggacagatttggtatctcttacaatacactaaatatacaagatcaatattctttaaatacaaactgggatttgtatgataaatggctatttgtcaaagatcatttgtatgccgctgacgcctcttataaaaatggccgtaaacaagcgtatttgaattatctaagcggatctggtggttcgtttccttattttgttgcaagtggacatagtagtcctggtacaaatgcctcaagattgtctacaggcctaacaacaccagcttttgcgagttggtatcctgacttccctcgggtaaattgttttatcgggatatgcacaattgcatttgaaggaacgaatatacttacaagcaattggatagaaggaagcgattttaaatatgtgggaatcatagctgctgattttccaggcggagggttaattgacaatattatttatctaaacataggaaaaggaacagtgcaggatggtacctatcaaatcattacagccttaaataatagtagtgttgtaaatcttgatcttaatcaaccgcatgacaatgttgtcttatggaataataacttcagcaataatcaaaagtggaagtttatatacgatactactaagtcagcatatcaaattaaaagcgtactaaatgaaaacctagtcttaacttgggcctacgatagtggtgacagagacaatgtagtcgctacttcaaatcaatataaaacttcgcagtattggaaacttaaatatatcggagggaattatcgctttataaatcttgttgaccttgaaggggcattagatgtaaataatggaaacactggaaacggtactcaccttctatattggaattttcaaaacagtagtaatcagaaatttagactcattgatactagcaagggaataattcaagatgggatctatcaaattgttaccgctttaaataatagtagtgttgtagatatgaatccagcagataaaaatgttcacttatggcaaaacggtaacgctaacaatcaaaaatggaggttcgtatatgatacgagtaaaggtgcatatcaaattagaaatctctcaaacgagaatttagtattagcttggaatgattttcaaggttcaaataatgtatttgctacacttaacttgttttatgatgagcatttttggataattgaaagttctggggatggatatttttatttgagaaatcgaaaaaatgttaataaagtattggatataactaatggaagttctgcgaatggaacaaatattatagtatggaattatcaaggaagtaataatcaaaaattcaggttgcaacaattaaatcaccaccaccaccaccactaataagaattc

SEQ ID NO: 4399 - DNA, 386 bp, Artificial Sequence
  Optimized for E.coli
ccatgggttgggacgttgacaccacaaaacgttttgacgaatggtttaaagcacagaccgaagaactgaaagaagacatgctggcagccattgtgattctgagcgaatacggtccgcacctggcacgtccgtttgctgacacagttgacggcagtgactttccgaacatgaaagaactgcgtgtgcagcaccagggtaaaccgattcgcgcatttttcgcctttgacccgagccgtcgcggcattgttctgtgtgcaggtgacaaaaccggcgtgaaagagaaaaaattctacaaagacatgatcaaactggcggacgctgaatttcgtaaatacctgaacggtggcgacaacggccaccaccaccaccaccactaataagaattc

SEQ ID NO: 4400 - DNA, 434 bp, Artificial Sequence
  Optimized for E.coli
ccatgggtagcattggcccggttagtggtaacggcattaccattacactgccggttggtaaaaccctgttttggacagcaaacgtgcaggcctcttactcacagtacgttctggtgcgtgactctaccaaccaggttgtgattgaatctaaaggcgcgtcaaccggtggccactcaccgacacagattggtcagggctcttttgttaccgctggttcaggcgtttacacagtgtttattggttacaacaacggccagagctggagtcaggtgatgtgggacgaaattgcactgaacattggtagccagatctacagcagttgtttcaacttcatcagtgaagacggcgcggaccaggactttaacgacacatgcctgaccctgacatggtttaacagcattggtcaccaccaccaccaccactaataagaattc

SEQ ID NO: 4401 - DNA, 1403 bp, Artificial Sequence
  Optimized for E.coli
ccatgggcagcagtcacgttccgcagccagaagctacccacgtgccaaacattgcagcccgcgctaaacagaaaccgatttggctgagcgaaaaaccgacaccgcaggttccgcaggacgtgtgggaacgtatgcgccagggctttcagctgcaggacaacctgggtgttaacccgcgcattgaacagcagcgtctgtggtttgcaagcaacccgagttttctggaaaacgccggtgaacgtggcagtctgtacattcactacattattgaacgcctggaagaacgtaacatgccgctggaactggccctgctgccggttattgaaagcgcatacaacccgatggcctactctcgtgcagacgctgtgggcctgtggcagtttattccgtctaccggtcgttactacaacctgcgtcagacacgcttttacgacggccgtcgcgacattaccgcgtcaaccacagcggctatggactacctgacacgcctgcacgacatgtttaacggtgactggctgctggcgctggcagcctacaacgctggtgaaggcaccgttagccgcgctattgaacgtaacgaaaaactgggcctgccgacagactactggaacctgccgctgccagctgaaacacaggcttacgttccgaaactgctggcactgagccaggttgtgctggcaccggaagcctacggtgtgaacctgaacccgattgccaacgaaccgtactttcaggttgtggaaattaaccagcgcatggacctgagtaaagttgcggctgtggcaaacattgacgaagacgaactgtttcagctgaacccggcctttaaacagcgtaccacaattgacggtccgcagcacctgctggtgccgacatctaaagcgcagctgctgaccgcttctctgtcaacaatgcgcccggaagaactgatttcttcacgtccgctgaaaccggtttttgaaggcgccgacgacaacgaaattgcaaaactgaaacgtgcctaccgcgtgaaacgtggtgacaacctggcagccattgcgaaagctaacaaagttgacgtgaaagacctgcagcgttggaacaaaatgaccggcaaaaacctgaaagttggtcagaccctggtgatgcaggacaacacaaaacgctctgcgggccgtattaacacagttgtggcggcttctggtaaatcaaaaggcaaagacaccggtaaaacagttgcgaaaacccagcagacatacaaagtgcagcagggtgactcactgtacatggttgctaaacgctttaacgtggaaatgcagcacctgaaacgctggaacccgcgtgttggccaggcactgaaaccgggtcagatgctgaccgtgagcagtccgcgtcaccaccaccaccaccactaataagaattc

SEQ ID NO: 4402 - DNA, 1883 bp, Artificial Sequence
  Optimized for E.coli
ccatgggtaaaccgcgtagcagtgacgacgcaaaacagattgtggaccgcatgaccctggacgaaaaaattggccagatgctgatgccggactttcgtaactggaagaaagaaggtgaatcatcaccgcaggcgtttacaaaaatgaacgaagaagttgctggcctgatcaaaaaataccagtttggtggcgttattctgtttgccgaaaacgtgaaaaccacagaacagaccgttcgtctgacagacgcgtaccagaaagcttctccgaaaattccgctgctgctgtcaattgaccaggaaggtggcattgtgacccgcctgggtgaaggcacaaactttccgggtaacatggcactgggcgccacccgttctcgcattaacgcgtaccagacaggtagcatgattggcaaagaactgagtgtgctgggcattaacaccgactttagcccggttctggacattaacaacaacccggacaacccggttattggtgtgcgtagttttagcagtgaccgtgaactgacagctcgcctgggtctgtactctatgaaaggcctgcagcgccagaacattgcgtcagctctgaaacactttccaggtcacggcgacacagacgtggacagccactacggtctgccgctggttagtcacaaccaggaacgtctgcgcgaagttgaactgtacccgtttcagaaagcgattgacgcaggtgccgacatggttatgacagcacacgttcagtttccggcctttgacgacaccacatacaaaagcaaactggacggcagtgacattatggtgccggctaccctgagcaagaaagttatgacaggcctgctgcgcgaagaaatgggttttggtggcgttattgtgacagacgcactgaacatgaaagcgattgctgaccactttggccaggaagaagccgttgtgatggcgattaaagctggtgtggacattgcactgatgccggccagcgttaccagtctgaaagacgaacagaaactggcatctgtgattgactcactgaaagaagccgttaaaaacggcgacattccgctgcagcagatcaacaaatctgtggaacgtatcatctcactgaaaatcaaacgcggtatttactctgcgcagcacgactcttcaattgacaagaaagttaagaaagcactgaaaaccgttggctcaaaacaccacaccaaaacagaacagaaaattgcagaaaaagccgttaccgtgctgaaaaacgaccagcacacactgccgtttaaaccgaagaaaggtagccgtattctgattgcagccccgtacgaagaacagaccgcgtcaattgaaaaaacaattcacgacctgatgcagcgtaagaaaattaaaagcgttagcctgaacaaaatgaactttgcggaaaaagtgtttaacgctgaacacgaaaaacaggttaaagaagcagactacattattaccggcagctacgttgtgaaaaacgacccggttgtgaacgacggtgttattgacgacaccgtgacagacagcagtaaatgggcaacagcctttccgcgtgccgtgatgaacgcggctctgcagcacaaaaaacagtttgttctgatgagtctgcgtaacccgtacgacgcagccaactttgaagaagcgcgcgctctgattgcagtgtacggttttaaaggctacgccaacggtcgctacctgcagccgaacattccggcgggtgttaaagctatttttggccagagcaaaccgaaaggtaccctgccggttgacattccgagtgtgacaaaaccgggcgacattctgtacccgtttggttacggcgtgaacattaaaaccggtaaaccgctgcaccaccaccaccaccactaataagaattc

SEQ ID NO: 4403 - DNA, 272 bp, Artificial Sequence
  Optimized for E.coli
ccatgggttctcagtacgttgcatacgaaggtccgggctttaccggccgttcagttgtgattgaccgctgtggtccgagcaacattccgtttcacggcagttacaaatggtacggtgacggccagagcggtcgtatgtacaaccagccgaacacccagggcgtgacacactttgaactgccgagcaaccgtaacgccgaacagcgcacaccggttggttggaaatctatttttattgtgtgccaccaccaccaccaccactaataagaattc

SEQ ID NO: 4404 - DNA, 704 bp, Artificial Sequence
  Optimized for E.coli
ccatgggcctgacagctggtgttcaggaagcgtgtgctcacggcgccattggtaccccgattgcgcgtcagtaccagtgtcgtctggaaggtggctactgggacccagctgacggtagtggtattccgcacacagactgtcgtgcagcctaccagaacggtggcaacagcgcttacccgtttacccagtggaacgaatttagtgcaaacccgattggccagggtgacgacctggaaaaactgcagcaggctgtgccagacggcctgctgtgtgcgggtggcgacaaaaagaaaagcggtattgacgttccggcagtggcctggcgtaaaacccgcgttacaccggtgggtggcaaaattgacgttacctgggaaaacacacagagccacaccccgagtgtgatgcgtatttacctgagcaaaccgggctacaacccgcagcagccactgcgttgggctgacctggacaaaatttacgacgctccagctccagcaccgcagccagcggacggtggcggtcgtctgccgggtaccgttacatctttttacaaactgtcagtgccactgccagctggtcgtacaggtgacgcagttctgtactcttactggcagcgtcgcgacgctggtaacgaaggtttctttaactgttcagacattaccattctgccgggccgccaccaccaccaccaccactaataagaattc

SEQ ID NO: 4405 - DNA, 2594 bp, Artificial Sequence
  Optimized for E.coli
ccatggcagcctacaccgactacagtatttacaaagttgaaccggctaaaacctttagcacagaaagtcaggcatctcaggcggctgcaaaactggaaaaagacacaggttgggacgctagttaccaggcatctggcaccacagctacctaccagattaccgcaacaggtattcacagcgaagcccaggcgaaaaccgttctgagtggcctgaccaaacagacagccattaccggtacaagcagtccggtgggctctaaacagccgtacatgaccattacatcaggtgcgatttcttcagaaaaacaggccaacacactgctggcgaaactgaaacaggaaaccggtgtttcaggcgccgtgaaaatgagcggcaccgcgcagttttacatgaacgttgtgacatctgaaattgcggaagaaaccaaagttaaagaactgattcagggtctgaccaagaaaaccggcattaaatcaacataccagccggtgacccacgaagtttcagtgacaagcattcagagtggtgcaattaccggcgacagcaaagccgcgcaggttaaaaacgcctttcagaaagaatcaggtctgaaagcgagcctgaaagaaacagccaaaggccaggcgtactacacctttaccacagccagcattagtggtgaagctaacgcaaaaaccctgctgcagcagctgaaacagagtaccggtattacaggctcttacaaatcaattaaccagaaaaccacagctgacgtttacaacgtgcagtctgcatactttaaaggtctgaacacagtgaaagacgcgattagccagattaagaaaaacaccggtgttagtggctactaccagaaagtgggcaaatctacctcatacacagttaacatgaaaaacctgacaaaacagcagctgcagaaagtggacgcatttttcaaaaagaaaaaatggcactacaccagcagtgcagttaagaaaaccgctacatcttcagcataccagattaccacagcccagattctgggtgaacagcaggcgaacaaagctgcagcatttttcacccagaagaaagttaaagccaccaagaaagcaaccggtaagaaagcagaaaaccagtaccagctgattagcgaagaaaccacagaccaggcgaaagttacaaaaggcctgaacgtgctgaagaaaaacaaactgagtgcggctgcaaaaaccgttaaaaaacagaccgctaacacattcaaaattaccacagaaagcctgctggaagccgcgaaagtgaacgaagcaatcacctttttcaaaagtaaccagatcagcgctgcaagcaagaaaaccggccagacagccgaaagcaaataccagattaccacagaagcgattattagtcaggaagacattgaccgtgttctggcatttttcaagaaaaacaacgcttctggtaccgcagtgaaaaccggcgccacagcgtacacccagtacaaaattctgacatcacagctgagcagtaaaaccgccctgaacaacggtctgaactactttaaagctctgcagctgtcagcaaactacaccacaaaaagcaacacactgtacaaaattagtctgaacgaacagtttaccggcaactctgccgcgtcagctgcaagcgcgaaactgaaacagctgtacggttggacatcttcaaccgttaaaatcaaaaacggcccgcagattatgaaaaccaactacaacctgtctctgcgcgacatggttcagaaacagatgaaagtgtcaccgcagacagacggtgccgcgtacgtgtctctgacctacattaacaccgccacatcaaccgttacagcggacgtgctgaacattcgtagtacaccggcagtttctccgaccaacgtgattggtcagctgaagaaaggtgacaaagtgaaaattattggtcagacaaacggctgggctaaaattaacatgggttggcgcaacgcaagcagtgacgaagttggccagtacgtggacccgaacaacttcagtaaagactctaaatactacttccagttcctgaaactgagtcagaccgccggtctgtctgttgcggaagtgaaccagaaagttctggccggtaaaggcattctgacaggcaaagctaaagcatttattgacgctgcaaccaaatactctattaacgaactgtacctgatttcacacgctctgctggaaacaggcaacggcacctcagacctggcaaacggtctgacatacaacggccgtaccgtgtacaacatgtacggtattggcgcatacgacagcaacccgaactactacggtgccaaatacgcgtacgaacagggctggtttaccccggaagccgcgattattggtggcgccaaattcatcggttcttcatacatccacaacacagcgtacaaccaggacaccctgtacaaaatgcgttggagcgccacagctgcacaccagtacgctaccgacattggttgggcatacaaacaggttaaccgcatgtactcactgtacagcctgctggacggctacaccctgtactacgacgtgccggaataccagcaccaccaccaccaccactaataagaattc

SEQ ID NO: 4406 - DNA, 1547 bp, Artificial Sequence
  Optimized for E.coli
ccatggaacaggaactgaacaaacacaaaccgccggttagtacaggttctggcgtgttttacgaaatctacatcaacagtttctacgactctaacggtgacggccacggtgacctgaaaggcattacccagaaactggactacctgaacgacggtaaaccgcactcaggcaaagacctgcaggttagcggtctgtggctgatgccgctgaacccgagtccgtcttaccacaaatacgacgttacagactactaccaggtggacccgcagtacggctcactgaacgactttcgtaccctgatgaaagaagcagaccgcaaaggtgttaaagtgattatggacctggtgattaaccacagcagttctgaacacccgtggtttaaagaagcgagtgctaacccgcagtctaaataccacaactactacgtttgggccgacgaaaacacagacctggaagaaaaaggtagttggggccagcaagtgtggcacaaaaacccgaacggcgaaggttacttttactgtaccttttggtctggcatgccggacctgaactttgacaacccggaagttcgtaaagaaatgatcaaagtgggtaaatactggctgcagcagggtgcagacggctttcgtctggacgcagccatgcacatttttcgcggtcagacaaaagacggcgcagacaaaaacattgcctggtggaacgaatttcgcagcgaaatggaaaaagttaacccgaacgtgtacctggcgggcgaagtttgggacaaaccggaaacaattgctccgtactttggtccgctgcactcactgtttaactttgacctgggtggcaccattctgaacagcgtgaaaaacggtcgtgaccagggcattgcaacctttgccgaaaaaacactgcagctgtacaaatcatacaacaaagcggctctggacgcgccgtttctgagtaaccacgaccagacacgtgttatgtctgaactgggtggcgacgtgcgcaaagctaaactggcagccagcattctgctgaccctgccgggtcagccgtttctgtactacggcgaagaaattggtatgaaaggcgaaaaaccggacgaatacctgcgtgaaccgatgcgctggtacaaaggcgacggtccgggccagaccacatgggaaaaaccgaaatacaacacaggtgaagttagtgtggaagcgcagctgcgtgacgacgactcactgctggaaagctaccgcaccctgattcgtctgcgcgaagaacacgaagcactgcgttcagacagcctgcagccgattcaggcgggtagtgcttctgttaccgcctttaaacgcacatctggcaaagaaaccatgtacgtttaccacaacctgtcaggtgaaagcgtgacactgcagattaaagacttcgacaaaggcaaatggaaagttatttttagcaccagcaaagacgttaaagttaagaaaggtaccgtgacaattccggcttactcaagcctgattaccgaagaagaccgcaaaagtcaccaccaccaccaccactaataagaattc

SEQ ID NO: 4407 - DNA, 1433 bp, Artificial Sequence
  Optimized for E.coli
ccatggcaacagccggttactcaggctacaccggtgcagccagcattgttaacggcgtgccgggtaaagtggcgacagctagtctgggcgcggttgtggacgctaccgttctggaccaggttgtggttgcaacagaagcaggtgcccgtgtgaccgttccggtgtctaccacagcggctgtggcagccgaaggcattgcgggtgctggcctgaaactggttccgtacctgggtgctgctctgacagcagcacaggttgcatcaatgctgaaaaacgccggcctgcgctacggtagttgttctgcacagagctggtttggcctgccagcatactgccagcagccgccggctgctgaccagtacctgtggcacggtggctttggtagtaacagcagtgtgccgtacccggacccgacatctgcatgtcagggcgacatggcagccctgattcgttcaaacagcacctgggccggttggaccatgacactgggctcttcaagcggtccggacgtggttggctgcgttctggtgagtccgacaggcgtggttggtagttctaactttaccgttgcctctcgttacctgaacccgaacccgggtcagctgccgccgctggcaccagccaccggcgacgacattgcgggtgctctgaaactgcaggcgattcaggactcaaacgcacgcaaagccctgtacgacgctattaaaagcgacctggcggctcacccggaataccagaccgcggacacaaacccggttcagccgtcaacaccggcaagcgttaccgccagtccggtgatttctccgacagttaccacacgcgttgacaccgtgccgaaatcagacggtagcaccgacacagtgaccacaagtcagtctaccacagttaacccgaccacaaccggcacaaccgtgggtgacattaaaacaacctttccgtcaacaaccacaaccacagtgaccacaaccaacaacgttaccaaccagacaaccacaaacaccagtgttacatctaacccggcgccgagcccggaactgaaaattccggacgactacaacaaagaagtgacacagaaacaggttgaaaaagacctgaacacagacgcagccccgccgatggacgaccagcagaaagtgattaccgacgctaacacaaaaggcgacaccgaccgtgacaaaatttacgacgacattaaaagtggtcagcaggacaaatcaagctggttttcatgggtttggagcccgccggttggcgtgtgtgctccaattaccggcgtgattgctggttttcacgttagttgggacctgtgcccgtctattgcgattattcaggctattattggctggctgatgggtatttttagcgcggctgaagtgtacggtcagctgtttaaacgcgaagaccaccaccaccaccaccactaataagaattc

SEQ ID NO: 4408 - DNA, 365 bp, Artificial Sequence
  Optimized for E.coli
ccatgggtaaagaacgtggctactacgacgttgtgtaccaccagtttagcgttgaagcagacgacagtccgatcatcaccaactctatcaacgttttcgtgggtaaaaccacactgaccaacgacacagacctggaacagaccctgagcacaaacagtttcgaaaaaatcttcgttaacaccattacaaactctaccacatcaggttacaacctgggcgtgaccgcatcagccaaattcagcatcctgagtatcttcgaaaccggcattgaaatgagcacagaatacgacttttctaacacctcagtgacagaaaagaaaaccaacattaacattcaccaccaccaccaccactaataagaattc

SEQ ID NO: 4409 - DNA, 1004 bp, Artificial Sequence
  Optimized for E.coli
ccatgggtcaggtgccactgcgtgaaggttacccgcagcgctacaccgttgtggcgggtgacacactgtggagcattgctaaccgttttctgcgcgacccgtggcagtggccagcactgtggcaggccaacagcagtctggcagacccggacctgatttacccgggtgacagtctggccctggttcaggtgaacggcgaaccgcgtctgaccctggaacgtggcgcaagccgcggtacagttaaactgagtccgcaggttcgtcgcaccccgctggcagaagccattccgacaattccgctgcaggccattgactcttttctgctgtcaaaccgtattctggaccgcgcagaaacctttgacagcgccccgtacattgttgcgggtgacgctgaacgtgtgctgagtggcacaggtgaccgcatttttgcacgtggccgctttgacccggaacagtctgcctacggtatttttcgccagggcaaaacctacacagacccgcagtcaggcgaactgctgggtattaacgcggacgaaattggtggcggtgaagttgtggcggtggaaggtgacattgctaccctgcagctgcagcgtaccacacaggaagttcgtctgggtgaccgcctgttttctggcgaaccgcgcgttattaactcaacatttgttccaagcccgccgagtcgtgctgtggaaggcctgattattgacgttccgcgcggtgtgacccagattggcgctctggacgttgtgacactgaacaaaggccgtcgcgacggtctggcagaaggcaacgttctggccgtgctgaaaaccggtgaaacagttcgtgaccgcgtggcgggcggtcaggttaaaatgccggacgaaggcgctggtctgctgatggtgtttcgtacctacgacaaactgagctacggcctggttctgaacgcgtctcgttcactggctattatggacaaagttcgcaacccgcaccaccaccaccaccactaataagaattc

SEQ ID NO: 4410 - DNA, 341 bp, Artificial Sequence
  Optimized for E.coli
ccatgggtcaggctccaaccccggaccaggctcgtcagcagcagccggtttttcagggccagtcaacccgcacagtgccgcagctgagcgactgtatttaccgtggctggagcaccacaagtgttattgcacgcgacaacaccacacacacccagccggacggttctgaaatttcagtgtttacatgggaagacagcatttttgcagacgttagtccgcgtcgcaaaggctctgacgtgaaatactttaccacatttcgtatggcgccgcaggttatggcagaccgtcaggccattgtggaacgctgcctgcaccaccaccaccaccactaataagaattc

SEQ ID NO: 4411 - DNA, 338 bp, Artificial Sequence
  Optimized for E.coli
ccatgggcagtaaagacaccagcagtgaacacctgcgtgcagaactgaaaaacctggccgacaccctggaagaagtgctgtcttcaagcacagaaaaatctaaaggtgaactggacaaactgcgtaacaaagcgcgcgttgctctggacagttctcgtgaacgcctgggcgaatcaagcgaacgtattgcagccaccacacgcgaagcggctcagaaagcggaaggttacgttcgcgaaaacccgtggcacggtgtgggcattggtgcagccattggcgttgcactgggtatgctgatttctcgtcgccaccaccaccaccaccactaataagaattc

SEQ ID NO: 4412 - DNA, 1106 bp, Artificial Sequence
  Optimized for E.coli
ccatggctctgccgccgcaggcttcactggacctgtttggtagtaaatctatgcgtaccacacaggaaagcgttgtgccggacctgaaagtttacccgggtggccagaccattggcgttaaagtgaaaagcagtggtgtgctggttgtgggccaccacattattcaagaaagtaacgaccgcaaagtttctccgggtgaaacagcaggtattcgtctgggcgaccgcattacccacatgaacggtaaaccgctgaacagtctggcacgtgttgcggaagctgtggacgaagccggtaaaaacaaaaaaccgctggacattacactgtgtcgcggcgaacagaccattagtacaaaactgaccccggcatacgaccaggacgacaaagcctggcgtctgggcctgtacattcgtgactctgcagccggtgtgggtaccctgacattttacgcgccggaccagggtgtttacggcgctctgggtcacgtgattaccgacatgaacacccagacaccgattgttgtgggttctggcgaaattgttcagtcaaacgtgacaagcattgcgaaatcacagagcggcgaaccgggtgaaaaacgtgctcactttctgaaagaccaccgtgttctgggtaacattgaacgcaacacaaactttggcatttttggtaaaatgtcagacgaaccgcagtacggcctgtacagcaccccgattccggttgcactggccaacgaagtgaaagaaggtccggcagaaattctgacagttctggaaggccagcagattcagcgttttcaggcagaaattgtgcacatttcacagcaggacaaaccggccacaaaaggtctggttattcgcattgtggacccgaaactgctggacaaaaccggtggcattgtgcagggcatgagtggttctccgattattcagaacggtaaactgattggcgccgttacccacgtttttgtgaacgacccgaaaagcggttacggctgctttattgaatggatgctgcgcgacgcgggtattatgcagaacaacgttagtctgaaatcttcaagcaacctgaaagcttctcaccaccaccaccaccactaataagaattc

SEQ ID NO: 4413 - DNA, 938 bp, Artificial Sequence
  Optimized for E.coli
ccatggcgcagaccgacctgacaagcctgaccgacgaaagtcaggaagttacactggaaaacggctctctgagcagtaaaattgctgttctggaagtgtcaggcaccattcaggacaacggtgactcttcaagcctgctgggcagcgacggttacaaccaccgtacatttctgaaaaacctggaacaggcgaaagaagacgacgctgttaaaggcattgttctgaaagtgaacagcccgggtggcggtgtgtacgaaagtgcagaaatccacaaaaaactggaagaagttaagaaagaaaccaaaaaaccgatctacgtgtctatgggttcaatggcagcctctggcggttactacatttcaacagcggctgacaaaatttttgccaccccggaaaccctgacaggcagtctgggtgttattatggaatctgtgaactactcaaaactggcggacaaactgggcattagctttgaaacaattaaaagtggtgctcacaaagacattatgagtccgtctcgtgaaatgaccaaagaagagaaaaacatcatgcagtctatggttgacaactcatacgaaggctttgttgacgtgatttctgaaggccgcggtatctcaaaagcagaagttaagaaaattgctgacggtcgtgtgtacgacggtcgtcaggcgaaaaaactgaacctggtggacgaactgggtttttacgacgacacaattgcagccatgaagaaagaccacaaaaacctgaaaaacgcaagcgttgtgagttacgaagaaagctttggcctgggtagtctgtttacaatgggtgccaacaaaatgttcaaaagcgaaatcgactttctgaacatgcgtgaagtgctgtcacagagcggtagtccgcgcatgatgtacctgtacgccaaacaccaccaccaccaccactaataagaattc

SEQ ID NO: 4414 - DNA, 299 bp, Artificial Sequence
  Optimized for E.coli
ccatgggtattggcgaagttgcatgtggcaaccgtgacgactttgtgaaactggacatttcttttggtaacggcatgggtaccaacaaatgctttgcaaacgccggcgttaccggtacaaacattggtggcgtttacaacgtgtttagcggcaacaacaaagttaccgtgaactacgaacgtaacggccgctacgaaaccagcacactgggttactggcagggcgttggttttagtggtacagttcgtgtgtacgaagtgcgcatttggcaccaccaccaccaccactaataagaattc

SEQ ID NO: 4415 - DNA, 218 bp, Artificial Sequence
  Optimized for E.coli
ccatgggtcagaccacagacaaagagaaaaacggccaccactacagcggtggcccgaaaaccgaagttccgcaccacatgggtaagaaagacaccacaggcagcagtaccaaagcaacatctggtggccaccactacaccggtggcccgaacacctcaacaccgcaccacatgggtgaaaaaacaaaacaccaccaccaccaccactaataagaattc

SEQ ID NO: 4416 - DNA, 533 bp, Artificial Sequence
  Optimized for E.coli
ccatggcaaccacaagcggtaccattaacgccaccctgacactgaccacaggctgtctggtgaacggtcagagtgcaacagccggcgttaactttggtaccctgaactttggcagcagtgcagccacatttgacaccctgaacgctacactggtgggtgctgctggtaacggtatttttgttcgttgcaccacaggccaggactacaacgttgtggttacctcttcaaacgcagccccggcaacaatttacggtacagcttctgctagtccgcgctacctggtgctgggttctgacaacgctcagggtattgcttacacactgtactctgacgcatcatttaccacagcaattgccaacaacaccccgattgcggcttctggcaccacagacccgacactgggtaccaactacgccatttacggccgtgtggttggtggcggttttaacccgctgattccggcgggcacctacacagacaccattaacgtggctgttaactaccaccaccaccaccaccactaataagaattc

SEQ ID NO: 4417 - DNA, 254 bp, Artificial Sequence
  Optimized for E.coli
ccatggacaaatactctaccgtgacaattaccaaaggtgacacactgtgggaactgtcaaacaaataccacaaccaccaccacctgaccacaaacgaatttgttaaatgggtggaagacgttaacgacctgaacagcgacacagcacagagcctgagtccaggtgacaaactgtacattccggtgctgaagaaagaactgcacaaccaggttgccattgaacagcaccaccaccaccaccactaataagaattc

SEQ ID NO: 4418 - DNA, 4679 bp, Artificial Sequence
  Optimized for E.coli
ccatggcgatcaccggtgtgagcccgatgaccaccctgaacaacatggcgaccgcggcggcggaggcggttgcggacccgctgccgctgcagggcccgggtctgggcaacctgacctacaccagcgcggaactgttcaagccggttagcatgattaccagcctggcgcacccgctggatccggcgcacagcagcgcgtatgagagccgtgaagtgccggcgacctatccgggtcgtaaagactacggcatgaacgcgggtatcatggttaacggctacttcctgaccagctttgcgccggacagcggtctgggtccgggtggctttctgctgtatgatgtgagcaacccgcgtcagatccaactggttaagaaaatttatgagccggaagcgcgtaccaaggagttccgtgaaacccacagctttggtaccgcgaagatcggtggcaaaacctatgtggttctgccgagcatttacggcgttgagttctgggactttaccgatatcaacgacattaaacaggttaagaaactggcgctgccgggcgtgaacgcgggtgattacgaagacgttagctggcagctgtggtggcaagcgccgtacctgtatgtggcgagcgcgggtcgtggcatcttcattgttgatgcgggtgacccggtgaacgcggtggttgcgaaccgtggtgcgggtaaaccgaacccggtgccgaccggcgagctgggcaacttccgtatcggcccgatttttacgatgggtaaccacatggttctgaccgcgatggaaagcaacggtggctttgcgagcctggatatcagcgacccgctgaacccgaaagttctggatagcattgtgggtaccaccccgttctactatgcgacctgctttgatggtcgtaacctgcacgcgagcacccgtggtagcggtgcgcgtatgtacagctatgatctgagcgaccgtagccgtttcgttgcggaggacaaccgtctggtgattgatgaacagctgtattgcgcgacccaagataactacgtgatccagggtgcgcaaacccgtattcacaaggtggacgttagcaacccgctgaaccacgttgaggtgggtcgtggcagcatcctgcgtgaagacgatccgaacttcagccacagcgataacggccaggttgcgatgttcggtaacctggtgtttgttggcaacgaccacggtagcggcagcggttttgtggttcatgcggtggacccggataccacccgtccggaagtgaagcaagtgagcccggcgaacggtgcgaaacagcaagcgctgaccagccgtatcggcctgggtatgaccgacagcattcgtccggaaagcgtgaacgcgaacaccttcatcgtgcgtgcggtgggtggcaacaccctggcgggtacctatagcgttcagctgggcatcattaactttcatccggagcaaccgctgagcccgggtaccagctacgaagtttttctgccggcgaacggcgtgaaggactatgcgggcaacgcgatcggtgcggattacaaaagcacctttaacaccggtaacgcgaccgacattaacctgatgcactattggaccctggcgggcaacctgagcgatcagatcggcaacaacaacggtaccccggttagcggtgacgcgttcgagagcattggcatgagctttgcgaaccgtaccgcgggtgttccgctgaagaacgacagcgttgcgaccgtgctgggtggcaccgcgagcctgagcttctacatgaaaaccacccaagcgggtggcccgaacagctggaccgcgccgggtatctttggtcgtgatcaaagcggtggcgcggacgatgtgttttggggttggctggacggcaacggtcgtattaagctgagcgttggtaacgatgcgggtaccaccagcaccgcggtggttaacgatggtagctggcaccatgtggttctgacccgtgatgcggcgagcggtgcgcaggcggtgtatgttgatggcgtgaagaccaccagcaccggtctgaccggcaacaagggtctgagcaacaaattccaagttctgggccagatccagggtaacgcggcgctgtttaaaggtaccctggcggaagtgcgtgtttacggccgtgttctgaccgatagcgaagtgggcaccctgcgtggtcaggcgatcattggcgacccgggtatcggtggcggtccgaaaattgttaacggtcagctggtttttgatccggcgaccctgggtagcagcggtgcgcaattccgttggaactttggcgacggtacccagaccgcgtatagcacccaaccgcgttacacctatacctacacccgtccgggtcactacaccgttaccctgaccgtgcgtgatgcgagcggtcgtgagaccttttatacctacaacctgaccgtgattgttccggtgaccgcgcgtgcgccgacccacaccaccaacattgcgggtgacgcgaacagcgtgtacagcctgaacccggacagcggtaccgttgcggcgatcgatgcgcagaccctggcgaagcgttgggaagtgcgtgtgggtgacgaaccgaaaaccctggcggtgggcccggatggtcgtatttgggttaccgtgcaaggtgaagacaaactggttgcgctgagcgcggcggatggtagcctgagcgcgaccgttccgctggcgtatggtagcggtccgtacggtgttgcgttcaccccggatggtgcgaagggtctgctgaccctggagagcaaaagcgttctgatgagctttgacccgagcaacggtaccaccaccggtgcggtggcgctggaaggcagcctgcgtggtattgcggttagcagcgacgcgcaggttgcgtatgtgacccgtttcaagagccgtatgaccggcggtcagctgcacaaagtgaacctgcaaagcatgagcgcgatgccgaccattgcgctgccggttgacaccaccaccgtggataccgaaagccgtgcgcgtggtgtggcgaactacctgagccaagtggttattagcccggatggtcgtcgtgcggttctgccgagcaagaaagataacattgtgcgtggccgtttccgtgatggtgttgacctgacccacgaccagagcgttcgtagcatcctgagccaggtggatctgcaagcggcggcggaagtgttcgatgaacaaattgactttgacgatcgtgcgccggcgcgtgcggcgctgttcagcccgccgggtgattacctgttcgtggcgcagatggagggcaaccgtgttgcgatcgtggacccgtacagccgtgcggttcgtggtgaaattaacgcgagcagcgcgccgcacggcctgtacctggatgcggcgcgtaagcgtctgttcgtgaacaactttctggcgcgtagcgttagcgtgcacgacgttgcgagcgtgctgagcagcgagagcgcggcggcgatcttcctgcagaacgttagcaccgtggcgcaagaaccgatggcggcggcggcgctgcgtggcaagcaggtgttctacaacgcgagcgaccgtcgtatgagcaaagataactacatcagctgcgcgagctgccatgcggatgcgggtgatgatggtatggtgtgggatttcacccagcgtggcgagggtctgcgtcgtaccattagcctgatgggtcgtcgtggcgcgggtcacggcaaaatgcactggaccgcgaacttcgatgaggttcaagactttgaaaacgatatccgtaacgagttcggcggtaccggttttctgaccaacgcggactttgcggcgaccgcggatccgctgggtgcgccgaaggcgggtaaaagcgcgcagctggacgatctggcggcgtatctgagcagcctgaacaagtatatgcgtagcccggcgcgtgcggcggatggcagcctgagcgttgaggcggtgcgtggccagaccgtgttcaacaccgcgcaatgcgcgacctgccacaccggcggtacctttcgtgacggtctgcgtcacgatgttggcaccatccagctgagcagcggtaaaggcattaaccaaccgctggcgggtctgggttttgataccccgaccctgagcggtacctggaacaccaccgcgttctttcacaacggtcaggcggcgaccctgcaagatgtgctgaacagcggtcacggcaacgcgagcagcctgccggcgccggacgtggttgcgctgcgtgaatatgttcgtagcctggataccgcgccggcggtggttacccgtatccgtagcgacctgaacccgaccatgtgcgtgaacattaagggcggtgcgaccgcgagcggtaccgttgcggtgcagtggccgtgcggtaccgcgagcaacgagaaattcaccgtgaccagcattaccggcggttacgttcagctggttgcggaacacagcggtctgtgcctggcgcaaaacggtaccgcgaccaccaacgcgccggtggttcaactggcgtgcaccgcgggtagcaccgcgcaatggagcctggtgggcggtaccctgcgtaaccgtggtagcggcagctgcctggacgttccgaacggtagcaccacccaagataccgcgctgatcacctggacctgcaacggcggtaacaaccagaactggacccaactgccgcaccaccaccaccaccactaataagaattc

SEQ ID NO: 4419 - DNA, 989 bp, Artificial Sequence
  Optimized for E.coli
ccatggctaacgcagccgtgtaccacgttattattagcaaaggtaaactgggcaacaaaagtctggcaattaccgccagcgacaaagacgacagtgtgtttattagcagtcacgaatacggtaacgaataccagctgtgggaaaaacgtagcgtgcgcagtggcgactcttcagcgtacgctctggttaacaagaaaaccggtaaatgtattggccgtcgctctgttgccaacggttcagaactgtacctggaagcggctagccaggcggacaccagtgacattatggtgtggaaagacgactctgttgcgggtacatacaacgctattaaaaactacgcagactgggaacagaaaattaacgtgccgcacagccgttttcacgaaggccagaaactggttacctgggaatggagtaacgcagccgacaacgaactgtggctgtttctggcggaaaagaaaaacatcaaaatcaaacacatggactttcagctggaaggcgtgtcaccgcaggttgaccagccgctggtgaccgacaaacagattgttaaaaacaccacaggtattgaccagacacaggtgctgaccctgtcttactcaaaaggcgttagctacagttttaacaccgaacgttctctgaaaatctcagaaacactggaatttaaagccggtctgccgctgctgggcgaaaccaaagtgaaaattggtgttgaaggcacacgcaaatacagcgaaaccaacgcgacagacgacaccgaagaactgacactggaagttccggtgaccgttccgtctggtaaaacaatcgaagtgtcagctatcgttatgcagggcaaactggacgtgccgtacaccgcagtttttgaaatttcttacccggacgtgacagttgaagaaaccgtgtcaggtatttttagcagtgtgaactcttactcagtttacacagaatttaaactgctgcaccaccaccaccaccactaataagaattc

SEQ ID NO: 4420 - DNA, 320 bp, Artificial Sequence
  Optimized for E.coli
ccatggcgagcagtgacgttagcattctgattaaccgtaccaactgtaaccagaacgactactttgaaattcacaacaacaacggtcgcgacacactgtgctttgcaaacgccggcagcatgccggttgcaatttacggtgtgaactggattgaaagtggcaacaacgttgtgacctttgaatttcagcgtaacctgagcgaaccgcgcctggaaaccgttacactggacaaatggcgttcttggcagccgggtcagccgtcaattcaccgtgtgacatggattcgcattcaccaccaccaccaccactaataagaattc

SEQ ID NO: 4421 - DNA, 401 bp, Artificial Sequence
  Optimized for E.coli
ccatgggtcagggtcacgaaccagcagctgctgttccaaaaggtccgtctctgaacgacgcttcacacccggaccacgctctgcacaacgctggccgttctaaactgccgagcgtgtttagtgaagaagctgcagccaacattaccctgcacgctaaacagaacggtattgacgcggctgacaaactgcagtcaattaaagttcaggacggcaaaccgtttgtgatgggtaccacaccgggctttcgcaccgcagttgacctggcacaggcaccgccgagcctggaacagacaagtgcaaaactgctggctgacccaagccaccagcagcaggttcacgaagaacagcagcgtgtggcgatgggtggccgccaccaccaccaccaccactaataagaattc

SEQ ID NO: 4422 - DNA, 1466 bp, Artificial Sequence
  Optimized for E.coli
ccatgggtagtgacggtggcagcagtggcgtttcttcagcgtctctgcagcaggtgtcagccaaagcttctgctccggcatgtgcagctgcttgggttgcaagcgcgatttacaccggtggcaactctgcgtcatacagcaacgtgaactacaccgctaactggtggacacagggtaacaacccgtcaaccgaaagcggcccgattggttcaggcaaaccgtggacaagcgctggtgcatgtggtgacgctgcaccgccggttaccccgccgccggtgaccccgccgccgggtgccaccacaggcaccattaactttcacctgctgctgggtgcaggctcagctcaggaccagctgctgctggacggtggcaactacaacgacctgattatgagcaacattgttgcaggtgtgatgtacggccacctgctgcagcagtactacccgggtatgcagtttcagaaagactacctgtacggttcaattctgggccagctgctgcaggaaaacattgccaccggtctgtacgttagcagtggcaacctgattgacccaagcccagaccagcaggctgtgatggctaccggtcagggtggcccgtaccagattaacaactacgccgcggacatggttagtggttcttacgccccggcgggccacagtctgattaactacgtggcaattcagaaaaacattggttacacaatggcaaacgctgcacagcagtacagtaaaccgacaccgccgtcttttaacaacaaatactacggcccgatgctgaccgcatactttcactacaacgactttgttgccctgattgtgaccggtaaaggcatgggtggctggaccacaccgtggcagccagactacgacaacgcgctggttaaatttaccaaactgccgaacaactttctggacgttctgctgaacgtggcttacaaccagggtttttacggcacactgatgtcttcatacagcaaactggccgcgaccgctacagcaagtaccgttacatctgtgaacgcgtacagcagtgtttggggtgctaccgacacatacaaacagtacccgtaccaagtgcgttactacctggaccagctgtacgacaacccgattccgaccacaagtgcaaccacatttgttaccccggcaaaccacgttgcctttggcgtggctgcactggaaaccgtttttagcaacgtgtttcagacactggcctacgtgaacggtagtggccagtctgcatacatttcagccgcgcaggcccaggctgcatttaactctgcactggctacagctgaagttgctgctggtgctacactggacctgagtaacgctgcaaaccgcgcgcagatttttagcgtgctggaaaaagctattggcaacctggaaacctcactgaacacaaaatttaacgctaccacaagcgtgcagctgcaccaccaccaccaccactaataagaattc

SEQ ID NO: 4423 - DNA, 596 bp, Artificial Sequence
  Optimized for E.coli
ccatggccccgctgccaacagctagcctgcacgttggtaccacatacgctcgttggctgtggccagttcaggcagtgcgtggtcagaccaacgcagcctctgtgtcactgcagattctgccgtctcagacagttaacgtgggtggcaaagtttcatttggtgtgaccgcccgtcgcacaggctacctgattctggttgacgtggacgcggaaggtcgtatgagccagatttttccgacaccggaactgctggctcagagtaacgaacgcgacattaacctggttaaaccgggcgtggaatttgtggtgccagcaccagctgctcgtcagcgcggttttgaatacgttgtggcaccgccggctggttctgcagttatgattgccattctgagtgaacgtcgcgttcagctgctggacctgccggacatgccacgtaaactggagggtcaggcagacgccctgtcttacctgtcagcatggacctctgaactgcgcgttccggacaacagcagtggcaaactggttacaaacaactggtcatttgacgtgaaaagctacagtattaaacaccaccaccaccaccactaataagaattc

SEQ ID NO: 4424 - DNA, 2504 bp, Artificial Sequence
  Optimized for E.coli
ccatgggtgacattctggttcagggcagccagctgcaggcaggtggtgacctgcgtctgacagcaaaaaacgacattagtctgctgtctgcgcagaacagtgaacgtacagactctaccaacagcagtaaaggtggctcactgggtattggcctgacagctggtagcggtggctacggtattagcgttagtgcctctgtgaacgcgggtaaaggccgcgaaaacggtaacggcctgacacacaccgaaaccacactgacagccggtaacggcctgtcactgaacgcgggtcgtgacacgatgctgacaggtgctcaggtgcgcggcgacagcgttaaagtggacaccggtcgtaacctgacactgaccagtgaacaggactctgaccgctacgacagtaaacagcagaacgcatcagccggtggcagctttacatttggtagtatgaccggctcagcaagcgttaacctgtctcaggaccgtatgcacagtaactggcagtctgtggccgaacagaccggtatttttgcgggcaaaggtggctttgacgttacagcaggtgaacacacccagctgaacggcgccgtgatttcttcaacagcgaccgctgacaaaaaccgcctggacacaggtaccctgggcttttcaaacattgaaaaccacgcggactacaaaacagaacaccagtcagttggtatgagcccggctggttcaaccggcagccagtttgaaggcaacatggcaaacggtctgctggctggcctgaacggtagtggctctgcaagcagtgttacaaaagcagccgtgagcgacggtaccctgattattcgcgacaaagctaaacagacccaggacgttagtgcactgtcacgcgacgctgctggtgcaaacccaggcctggacaaaatcttcgacaaagaaaaagaacagcgtcgcatggaaacagctcagctgctggcagaaattggtagtcaggccggcgacattgcgcgtacctacggtcagattgaagcaacaaaagcagccaccgaaaaaatgaaaacagttaccccggaccagaagaaagacgcagaagcccagtggcgcaaagccaacccgggtcaggaaccgacagcggctgacattaccggccaggtttaccagaccctgtacaaccgtgaaatgctggcgggtggcatgggtacaggtggctcagtgcagcagggtatttctgcagcaacagctgctattcagggtctggcgggtggcaacattgctcaggctatgtcaggtgcagctgctccatacctggctgaacagattcacaaactgaccacaaccaaaggtccggacggcaaagaagttgtgaacgttcaggccaacctgattgcacacgccgttgtgggtgctgtgacatcatacgcatctggtaacccggctctggctggtgcatcaggtgctgcaatgggtgaatacattgcacagcagatgtacccgggcgttaaacgtgaagacctgagtgaagaacagcgccagacaatttcagcactgggtaccctggctgctggcctggcaggtggtgttgctggtgactcaaccggtggcgccgtggctggtgctcaggcaggcaaaaacgcagtggaaaacaacgctctgcacgcaccggacgagaaaaaacgtcaggacgcaaaatggagcctgccgtacctggaaggcgagaaaaaacagcaggccgaacagctgattagtgacctggacgccaaagacaaagcgtttgacgttgctctggactctgcatgtaaaggtctgtcttcagctgcatgccagggcatgcgtcaggaactggccgcgatgggtaaatcatacagcgaacagctggacggccagtacattggtaacatgggcagtgtttacaaagaaggtaaaggtcaagtggacgccctgatttggcagtacgccaccgcggacgctaaagcagaacgtgacgctaacgttaaccgcattgcagaaaactggggtgtgtctaaagaaacagcggacggtctgtacacaacaatggcaggtgttcacacagctgcagcaattggtggcgcgctgtggggtctgaaaggtccaggtacagttaccgtgtaccgtgttgaaggcacaccgaacacccgcgttgtgattggtgacaacggccaggtgagtattaccggtaacacaaccctgtacctgaactttggcgacaaagcccgtgcgctggaatttttcgaaaaacgcggttctcagaacatggacggcgcggctattaaaacatttgaagttccgcactcagtgctggacgacctgcgcaacaccgttgtgaaagaaagcgttgctcgtctgccggaaaacaaaggtaaaccggtgattgccgacccgacaaaagcgaaagaccagtacggcattcgcccggaaaaactggaagaactgaaagacaaaatcattcagggtaccggccgtaacgcctctaaacaccaccaccaccaccactaataagaattc

SEQ ID NO: 4425 - DNA, 689 bp, Artificial Sequence
  Optimized for E.coli
ccatgggttaccaggcttacaccctgagtgacgaccaggtgaaacagctgagtgacaaatcttgtgaacagatggacaaagacaaccagattgcaccggccaactctgactaccagcagcgtctgaacaaaattgcagccgcgctgggtgacaacattaacggcgttccggccaactacaaagtgtaccagaccaaagacgttaacgcgtgggctatggcaaacggttgcattcgcgtgtactcaggcctgatggacatgatgacagacaacgaagttgaaggtgtgctgggccacgaaatgggtcacgttgccctgggccacacccgtaaagcgatgcagctggcctacgctacaaccgctgctcgcaccgctgctgctagcgttggtggcgtgattggctctctgtcacagagccagctgggtgaaatgggcgaaaaactggttaacgcccagtttagtcagacccaggaatctcaggcggacgactactcatacgacctgatgaaaaaacgtaacattgacccgatgggtctggctacaagctttgaaaaactggcaaaaatggaacagggccgtcagagcagtatgtttgactctcacccggcttctgaagcacgtgcagcacacattcgtgaacgcattgcggctgactctaaacaccaccaccaccaccactaataagaattc

SEQ ID NO: 4426 - DNA, 2159 bp, Artificial Sequence
  Optimized for E.coli
ccatggctagtgcatctgaacgtagcgcagttaagaaaggtaaagtggcagccaccgcaaagaaagcagaaaagaaaaccaccaagaaaaccgcggctgtgaaagcaggtaagaaagttgccagtcgcaaaacagcaacagctccagttcgtgtgctgaacgttcgtccggacggcctggactttcgtgacaccatgtacattccgacactggttgaagtgccggttcgtcgcgaactgagcgactaccgcgaaacccgtgtgccggttctggaccagggtcaggaaaacgcctgtaccggttacggcctggctacagttgcacactacctgctgcgcacccgtcgctaccagagtgacgcgacactggtgtctccgcacatgctgtacgacctggctcgtcgctacgacgaatgggccggtgaagcggacgaaggcagcagttgtcgtggtgcaatgaaaggctggtacaaacacggtgtttgtccagccccgcagtggcaggctggtaaccaggcgaccacactgacccaggtgctggcagaagaagcagcactgcgcccgctgggtgcatactttcgtgtgaaccacacagacattgttgcgatgcacgcggctattgctgaagtgggcgttctgtacgcttcagcaagcgttcacgaaggttggcacgttgtgggtggcgacggtcacattcagccaagcgcgaacattctgggtggccacgcctttgcgattgtggcttacgaccaggacggtttttggattcagaacagttggggcgaaacctggggttacgaaggctttgcgcacctgcgttacgacgactggctggctaacggtgctgacgcatgggttgctcgtctgggtgcaccaattaccctgcgtgttccgctgcaggcctcttcacaggccaaagcggtggcagccgcgagcagttctgaaacactgcgcgaaattcgtccgcacgtgatttctctgggtaacgacggtgcatttgacccgcgcggtgacctggcaaccacagctgcatcagtggaagaaatttttgcggttgactttccgcgcattaccgctggctgggccaaaaaacgtattgttgtttacgcgcacggtggcctggtggctcaggcaggtgccattgaaacagttgctggctaccgtgccgcgatgctgcaggcagaatgttacccgctggcctttatttggaaaaccgactactggagcacactgggtaacatgctggcagacgctgcacgtcgccgtcgcagtgaaggcgttctggacgccaccaaagactttatgctggaccgtctggacgacgctctggaaccgattgctcgtctgctgaccggtaaagcggaatgggacgaaatgaaagaaaacggcctgcgtgcaacagtgtctgctaacggtggcgctcgcgttgtggcgaaagcactggcacgtctggctgctcagggtgtggaaattcactttgttggtcactcagcgggcagcattctgctggctccgatggtgcagtacctggtttcacgcggtgcaatgaacagcggcccgatggcccgtagtcagctgaaaggtctggaagttaaaattgcatcttgccacctgtgggcaccagcttgcacagtgaaactgtttcgcgaaacatacctggccccgattcgcgacaaacgtattgaaaaatttggcctgtttaccctgacagaccaggcggaacgtgacgaccactgcgctcacatttacaacaaatctctgctgtacctggtgtcagacgcgtttgaagacaaagttcgcattccgctgattcgtccggacggtgaaccgattctgggcatggaacgttttgttaccggtgaatctgacctggcacagctgtttgctagtgcatctaacgcagactgggtgcgtgcaccaaacgacctgccgatgggcaaccagaacgcctcaggtgcgcgtcaccacggcgactttgacaacgacgaaaccacagttcgcgctacactggcacgtattctgggtcagggtggcgcccgtcacgctctggttctgagtcagccgattgctgaacgtgctcagcgtcgccgtcaggtggacctggcatcaagcattggccgccgtcagccgcaccaccaccaccaccactaataagaattc

SEQ ID NO: 4427 - DNA, 2477 bp, Artificial Sequence
  Optimized for E.coli
ccatgggtcagagcgcacagacatttaacgcaccaatgccaggtgctccagctaccccggacgcacaggcccgtccgccgggtggcattctgtctccgtttctgctgtcagcacagctgggtcgcgacctgatgctgcactacgcgattgacaacaacaacgctaacgcagccggtgttccatgtgctgacctgggcgctgactcagcaagctgcgccacaggtcgtctgattctggaaaaccgtggccaggctcgcattagcggtgacggctggaaactgtacctgcacagtattcgtcgcctgctgcgtattgaccacccgggttttacactgcgccacctgaccggcgacctgtacgaactgacaccgaaaccaggtgctctgaccctggctccaggtgctcgcctgaccgttccgtttgtggctgaatactggtttctgcgttacagcgacctgctgccgcgtccgtacgttattgtgccgggtgccctgccgacagttctgcgtcacaacgacacagacgacgaaacccgttacgtggacagtctgccagctgacgctcagagcagttctacaggcaacgcaccgccggctgctgtgcagccagtggcaagccgtgcactgccgagtgttaaacgtgaacgcctgggcaacgacacagttgaactgcgcggtgtgcagctggcactgacaggcctggcagcaaaccacgtggctgctctgcgcgaacgtgcaggtgaactgggcctgggtggctctggtctgccagttcgtggctcaattgtgccgcagcagctgccggcggacattgctattccgggtggctaccgtctgtctattacacgccagggtgcaaacattgaagcctacgaccagaccggtctgtactacggcgttcagacactgttttcactgaccccggcaggtggcggtcgcattccggcaatgcaggttgaagacgccccgcgttttccgcaccgtggtatgcacgcagacctggcacgtaactttaaacacgcagacaccctgcgcaaactgattgaccagatgagcgcctacaaactgaaccgtctgcacctgcacctgagtgacgacgaaggttggcgcattgaaattccgggcctgccggaactgacagccgttggtagccgtcgctgtcacgacccgagtgaaaccctgtgtctgctgccacagctgggttctggtccagacaaccgtagtggcggtggctacctgcgtcgcgacgaatacgttagtctgctgcgttacgcagccgaacgctttgttgacgtgattccggaaattgacatgccagcacacgcacgtgctgctgttcagagcatggaagtgcgttaccgcctgtttcacgcgctgggtcgtgaacgcgaagctagtgaataccgcctgattgacccgcaggacaccagcaacacactgagtgttcagttttacgaccgtcgctcttacctgaacccgtgtgcaccgggctcactgaaatttgccaccaaagtgattcgtgaaattgcagccatgtacgcggacgctcaggcaccgctgccgatttggcactttggtggcgacgaagcgaaaaacattctgctgggtgctggctttcagccgctgaacggtacagacccgaacaaaggtcgcgttgaccaggctgctcaggacctgccgtgggcacgttctccgatgtgcacagcactgctgcagcgcggtgaaattaaatctacagaagaactgccgacccgctttgcgcagcaggtttcagctcaggtggcagccaacggtattggcacaatggcggcttggcaggacggtctgaaacacgcgaacggcccgcaggacttttcaacccgtaacacaatggttaccctgtgggacacactgttttggggtgcagccgactctgcacgtgactggtcagccaaaggttaccgcacagtgctggctctgccagactacctgtactttgactttccgtacaccacaaacccgcgtgaacgcggttactactggggctctcacgctaccgacgaatacaaagtttttagctttgcgccggaaaacctgccgcagaacgctgaagttattggtgaccgtgacggcaacccgtttgaagttacaggcacgggtgctgctccgcgcctggagggtatgcagggtcaggcatggggtgaagttatgcgtaacgacggcgaatttgaatacatggtgtacccgcgcctgctggcactggctgaacgtgcttggcaccgtgctgactgggaacgtccgtacgcagccggtgttcgctacaaactgggcgacacacacctggtggacaaagacgcactgaacaaagactgggcgggttttgctaccgtgctggaacagcgtgaactgccgaaactgggtcgtgctggtattggttaccgtccgccgacctttagtctgtctggttcacaccaccaccaccaccactaataagaattc

SEQ ID NO: 4428 - DNA, 842 bp, Artificial Sequence
  Optimized for E.coli
ccatgggtgaaattcgtctgtacaccgacgacaactttaaaggccgtgttgtggttctgcgcgacaccacagacgacctgtcacgcgttaactttaacgacacagttagcagtattcaggtggactctggttcatgggaagtgtgtacccacgcagactttaaaggcgactgcaaaacactggaacgtggtgactaccgcagcatgccgggcatgaacgacaaaatttcttcagttcgtgaaaccggtgctggtcagggttctggttctggttctggtggcggtcgtcgcgcagcactggaactgtttgctgacggcggtcagcgtggtgcaagtgccggcgttaactctgaccgcgacgacctggtggacattagttttaacgaccgtgcgagcagtgctcgcgttgaatacggttactggcagctgtgttcagacagcaactaccgtggctcttgccgcgtgtttggtccgggcagtcacgacgacctgggttctctgaacggccgtgtttcttcagcgcgcctggtggacccgcgtgaagaaaaccgcccgcagaacgacgaaggtctggtggttctgtacggccgcgcttttctgaaaggtccgggcctgcaggtgaaccgtgacgtttcagacctggtgcgcctgaactttaacgaccaggcggctagcctggccattaacgaaggtacctgggaagtttgtacagactcacagtttaacggtagctgcgaacgtatgggtccgggcaaatacgaagtgctgaacaccacactggacaaacgcattagcagtctgcgtcgcctgtaccaccaccaccaccaccactaataagaattc

SEQ ID NO: 4429 - DNA, 620 bp, Artificial Sequence
  Optimized for E.coli
ccatgggccacaccgaatacagccgtacagcgatgcagcacgttgacatgagtgtgaccggcattccgacaattctgggcctgggtaccctgggtacaagcattccgctgaccccggaatacagtctgacagcagcccacgttgcaaaaaccgccgttcagcgtgtgaaaagctaccacccgtactgtgacctggcgattatttaccacaaaaacgacgcttctaccctgacaaaatttcgcaactcagacattggcgacccggtgaaaatgtacggttactcttttatttcagcaatgccggttgaatctaccggtgtgaacctggcgcgtacagctattcgcaacaactggaacaaatctccgtgcattgcgatggcttcaaacgccggcgttgtgcagggcatgtcaggtggcggtgtttacaaccgtgacgacacactgggcggtgttattgtgggctacagcgacagtattaaaaacggtcgcaacaacaaagttattctgaaagacgtgtctctgtacattccgtacggccagtttaaaagctggctggaaagtaacctggcacagaccccgacacgcggtgcccaccaccaccaccaccactaataagaattc

SEQ ID NO: 4430 - DNA, 536 bp, Artificial Sequence
  Optimized for E.coli
ccatggcggaaaccacacaccgtgttaaagctggcgaaaccctgtacaaaattggcgcagaatacggtgttacagtgcagcagctgaaagaagcaaaccacaaaagtaccgactctattaacgccaacgaaaccctgacaattccgaacagcattagtgaatctgacaaagaactgctggcgcgtctggttcaggcggaagctaaaggcgaaccgtacgctggtaaagttgcagtggccacagttgtgctgaaccgcgtggactcagacagctttccgaacagcattcacgacgttatttaccagggcacccagtttacaccggtgcagaacggtgaaattaacaaagcagccgacgcggaagcaaagaaagcagtgaacgaagcactggcctttcgtggtcagggcaaaggtagcctgtttttctttaacccggacaaaaccagcgaccagtggctgcgccagaaacaggttaccattacaattggtaaccacgtgtttgccaaacaccaccaccaccaccactaataagaattc

SEQ ID NO: 4431 - DNA, 1046 bp, Artificial Sequence
  Optimized for E.coli
ccatgggtcacaccgtttctccggtgaacccgaaagcgcagcagaccacaaaagacgttatgaactggctggctcacctgccgaaccgttctgaaaaccgcgtgctgtctggtgcgtttggtggctactctcacgacaccttttcaatggcagaagccgaacgtattcgcagcagtgcaggccagtcaccggccatttacggttgtgactacgctcgtggctggctggaaacaagcaacattgaagacagtattgacgttagctgcaacagtgacctgatttcttactggaaatcaggtggcattccgcagattagcctgcacctggcgaacccggcttaccagagtggtcactacaaaaccccgattacaaacgaccagtacaaaaaactgctggactcttcaaccacagaaggcaaacgcctgaacgcaatgctgagcaaaattgccgacggtctgcaggaactggaaaaccagggcgttccggtgctgtttcgtccgctgcacgaaatgaacggtgaatggttttggtggggcctgaccagttacaaccagaaagacgacgaacgcatttacctgtacaaacagctgtacattaaaatttaccactacatgaccggtgaacgtggcctggaccacctgctgtgggtgtactctccggacgcgaaccgcgactttaaaacagacttttacccgggtgcatcatacgttgacattgtgggcctggacgcctactttcaggacccgtactctatttcaggttacgaccagctgaccgcgctgaacaaaccgtttgcttttaccgaagttggtccgcagacagcaaacggcaactttgactacagcctgtttatgagtgccattaaacagaaatacccgaaaaccacatactttctggcctggaacgacgaatggagcccggcggtgaacaaaggcgctagcagtctgtacaacgacaactggacactgaacaaaggtgaagtttggaacggcaacaccctgacaccgattgtggaacaccaccaccaccaccactaataagaattc

SEQ ID NO: 4432 - DNA, 1040 bp, Artificial Sequence
  Optimized for E.coli
ccatgggtaaaaaactggaaccgaaagaagcagttaccacaggcaccgcgaacgctatgaaactgaacagttacgaaagcaaaagtcagttcacaatcaaagaactgaccatcacatctgcgtcagttccgtctgaacagtcagctatggtgacctcaatgctgaaaaacgccgacattacactggacggtgtgtaccagaaagaaccgtttcagagcgaaatgaccctgggtattcacctgaaaggcgacctgagcaccagttttacaattccgatggttatgacaaaagacaaactgtacgtgaaaattccgaacattccgttttacccgctgccgcaggacgttgtgggtaaatttctgattattgacccgcaggaactggcgaaacagagtggccaggaatttaacccggcagcaatggaccaggaaaaatctcagaaatttgcgaacgaagttattgcggctattatgaacgaatacgaccaggctacctactttttcgacattgacccgaaagacgcaaaactgccgcagggtgttgaagccaaacaggttgtgcagtttaaaattaccaacgacaacgtgaaacaggcgaccaacacatttattacaaaagctctgccgaaagttctggacgtgatgagcaaagacgaatacgcgggcatgctgcaggttaagaaagaagaactggcagaagcaaagaaagaactgcagagcaacaccagtgaagtttctaaaaaactggacgaactgaaaaactacctgaccgtgaaacagtttgacattaacacagctctgaacaaagacaacattccggtttaccaggacctgaacgcaaacgtggaaatgaacgacccggccaccaaagacaacgttaaactgtcagtgaccggctacacacagtacagcaaaattaacgcaaaagcagcctttaaagttggtattccgaccggcgaccaggtgctgacaatggaacagctgcagcagaaaatgcagacagttgccccgcaccaccaccaccaccactaataagaattc

SEQ ID NO: 4433 - DNA, 896 bp, Artificial Sequence
  Optimized for E.coli
ccatgggtagcattaaagtggacattaccgcaagcagtgacaaccaccagacaattgcaaccgccaccggtaacgacatttctgttatttcaaacgaagaacgtggcacctttcagctgaacgaccagcagctgaaacgcgcggttgaagtgtactttggtaaaaaaccgaacgacgcttacctgtcttcaccgaccccgtggggcgacctgtacaaaacatacaactggcagcaggtgatgcgtaccctgcagccggtgtctacacgcgttattagccagaacagtacaccggttattgtgatggaacaggactttgttaacaacagcagtgttccggcggtgtacaacgttaaaatttctcagtcagtgcagaacaccgttaaatcttcatggaacaccggtggcaaactgacagtgggtcagaaagttaaatacggtatctcatttctgggcacaggtggcggtggcgaaagcagtattagctacgaacagagttggggcattggtggcgaacagtctaccacaattaccctgggtacagaatctggcctgcaggttacactgcagccgggtcaggctgtgacagctgaactggttgcttctcgtggctcaatgaaagttcaggtggactaccaggcaagcctgagtggtattagtgccgtgaactacaacccgacctacaaagaccaccacttttggggcctgccgattacacagattatgcgctcttcaaacattagcaacgcaattgttagcagtgaaattattgacattggcttttacgccgacagtaaagtgattctgcgtgacaaaaacaccggtggcgtttttcgcacatttaacctgtttgacaaacacaccgaccaccaccaccaccaccactaataagaattc

SEQ ID NO: 4434 - DNA, 377 bp, Artificial Sequence
  Optimized for E.coli
ccatggaacagccgaaagttgaagtgtttcagattgaaaccggtaaagttgtgcgttctacaccgaaaccgccgtcagttcagaaagaagcggaaaaatctattaccagtattacaggtctgtacaagaaagcaagcccgctgccgaagaaaggttacctggttaaagtgccgctggacccggcagttaaaattgaaaacagcgcagtgaacaccctggcctctgaagttatttttgtgctggaaccgaaccagaaaccgattatgatggtgtttgacaacgaaaaccgtacatactttttcgaatttacccacgacctgacactgctgcgcaaagcgctgcagctgcaccaccaccaccaccactaataagaattc

SEQ ID NO: 4435 - DNA, 725 bp, Artificial Sequence
  Optimized for E.coli
ccatggaaaaccgtgaaacaggtacagctccagctacacagccgccgtctgcatctgcaccgccggctaacccaagtgctaaaccaacaacaacagaaaccctgccgccgccgacaacagctccagctgaaccactgccatctgctgtgccgccgagctcttcagacccagctccagcagctgacccagttacatttacctttgcggacggtcgtctgtcatttacacacccagctggttggcgtgtggaacacagccagaccgttgcaagtccgtctgtgcagaacgccacagtttacgacaccagtggtaacgaacagattggcatcttttactctgaagttggtggcggtgtggctggtccacacacacgtaccgttttctttagcgaaccggtgccaggcctgcagggtcactctggtccagcatctggtccagcaacagcacacgttagcttttacgtggaccacatttacggcgaaccgcactactcactgagcctgacacaccgtgaagcactgagtccggacggtaccgaaggcgccgacgttgtgattgtgggcggtaaccgcgttctggcggctaacgttgtgtttacaggcggtccgtttgcaagcgacgaagcagccaaagcgtggtttgctggtaccgaaggccaggcactgaaagccattctgatgagtttttcttaccgccaccaccaccaccaccactaataagaattc

SEQ ID NO: 4436 - DNA, 407 bp, Artificial Sequence
  Optimized for E.coli
ccatgggtcgtctgcagaaatacaccagcaactgtaacaaatacgttatcatcgaataccaggtgagctactacagtcagcagattcaggcagacattatgtctctgccggcaaccctgcaggcccgttacctgtcactgacagcgcgcatgaaaatttacggtccgcacctgggcgaaccgcacacaaaagttctgggtaacggcctgctggaactgcgtctgaagggtgcggaaggcattgctcgcgtgttttactgcacaatggttggcaaacagattgtgatgctgcactcttttgttaagaaaacccagaaaatcccgttcaaagaaaaacgtatcgcagaaatccgtatgcgcgaagtgaaaaacgaacgccaccaccaccaccaccactaataagaattc

SEQ ID NO: 4437 - DNA, 2618 bp, Artificial Sequence
  Optimized for E.coli
ccatgggtaaccagcaggttgtggaccagctgtcacagctgcaggttaacctgaaaatgctggacaaccgtgcagccgaaaacggtgtggactgtgccaaactgggcgctgactgggcatcatgccacaaagttctgattaccctgacaaacggtaaccaggaaattaaagacaaagactgggcgatttactttcacagcccgcgccagaccctgaaagtggacaacgaccagtttaaaattacccacattacaggcgacctgtacaaactggaaccgaccgacaaatttacaagctttccggccaaccaggcggttgaaattccgattattgctgaatactggcagctgtttcgtaccgactttctgccgcgctggtacgccacatctggtgacgcgcagccgaaaattctgtcaaacaccgacacagaagacgttaaccagtttgtggccccgtttaccggcgaccagtggaaacgtacaaaagacgacaacaacattctgatggttccggaatcacgctttaccaaaaaccaggacctgaaagtgctgccgatggccagcctgcgtggtcagattattccgacaccgatggaagttaaagtgcacgcgaaagacattgacctgagcaaaggcgttgctctggaactgagtgcactgacaaaaccagctgctgacgcagctgctgaacgttttgctctgctgggtattgaaagtcaggctaacggctacccgattaaaacagacattaaaccggctgcatttaaaggtgaccaggctgtgccaggtgcttaccagctgaaaattggtgaaaaaggcgctgaaattgttggttttgaccagaccggtgtgttttacggcctgcagtctattctgtcactgattccgagcgacggtagcaagaaaattgcaacactggacgctaaagacgcaccgcgttttcagtaccgcggcatttttctggacgttgcacgtaactttcaccagaaagacgctgtgctgcgtctgctggaccagatggccgcgtacaaactgaacaaatttcactttcacctgaccgacgacgaaggttggcgtattgaaattccgggcctgccggaactgacagaagtgggtggccagcgctgtcacgacctgtctgaaaccacatgcctgatgccacagtacggttctggtccagcaccgcacggtggtttctttagccgtcaggactacattgacattgttaaatacgcccaggcgcgccagattgaagtgattccggaaattgacatgccggctcacgcacgtgctgcaattaccagtatggaagctcgctacaaaaaactgctggcagagggtaaagaaaaagaagccaacgaatttcgtctggttgacccgaccgacacatctaacaccacatcagtgcagtactttaaccgccagtcttacctgaacccgtgtctggacagcagtaaaaactttgttgacaaagtgattggtgaagttgcccagatgcacaaagaagcgggccagccgctgaaaacctggcactttggtggcgacgaagcgaaaaacattcgtctgggtgctggctacacagacgtgaaaaacccggaagcgggtaaaggcattctggacctgagcaaagaagacaaaccgtgggcaaaaagtcaggtttgccaggccattattaaagacggtaaagtggaagacatggaacacctgccgtcttactttggcctggaagtttcacagctggtgaaagcgcacggtattgaccgcatgcaggcttggcaggacggcctgaaagacgcaaaagacagtaaagcctttgcgaccaaacacgttgcagtgaacttttgggacacactgtactggggtggctttgacagcgctaacgactgggcaaacaaaggttacgacgttgtgattagtaacccggactacgtttacatggactttccgtacgaagtgtctccggacgaacacggttactactggggcacccgtttcagcgacgaacagaaaatttttagttttgccccgaacaacctgccgcagaacgcggaaacctctgttgaccgcgacggcaaccactttacagccaaatcagacaaaccgtggccaggtgcatacggcctgtctgctcagctgtggagtgaagttgtgcgtaccgaccagcagatggaatacatgatttacccgcgcgcggttagcctggctgaacgtgcttggcaccgtgctagttgggaacaggactacaaagcaggtcgtgaatacaaaggtggcgaaacacaccaggtggacaccaaaacactggaccaggactggctgcgttttgctaacctgattggccagcgcgaactggctaaaatggacaaagcaggtgttagctaccgtctgccagtgccaggtgcacgtattattggtggcaaactggaagctaacattgcactgccgggtctgggcattgaatacagtaccgacggtggcaaacagtggcagcgttacgacgacaaagcccgcccgtctgttgctggtgacgtgcagattcgtgcaatttctccggacggcaaacgtttttcacgcgctgaaccggtgaaagcacaccaccaccaccaccactaataagaattc

SEQ ID NO: 4438 - DNA, 1934 bp, Artificial Sequence
  Optimized for E.coli
ccatgggttttgtttttattccagcagctggtgctggtcagccactggcaaccacatacccaaacggcgaaatttacaactacccgattcgctcaattattagctttgcaagcagtgttgacgtgattggtagcaaactggcccagagtctgtcttcaagcgtttttcagggtgaaagcctggacgaaaaaaccctgggcagttcttttggtggccgccacaacaccacactgacctacctggacggcgcgacaattctgtcaaacgtgaacagcctgaaacgtagtaaaattctgctggacgctggtgttccgctgctgattcgtgtggaccgcaaccagctggaagttggcaaacaggtggcggctctgtttggtgttagtattcgttctggctacatgctgctgagcaaagacggtccggcgaaactgacagtgtttaacctgcaggcgccggacaacaccgctattccgaacggtctgatgcaggcgctgggcgctgttaaacagaaaaacgtgctgccgagtctgcgcgcgaacattcgtgctctggaaaccgaccaggttggtattccgaaagtgacactgaacctgaacagcgctgacgttaccggccagattgttagtattgtgaacctggacctgattcgctcagcgagccgtggcaacgacaaaaaattcatcgttgtgaaagctaccccgacagtgcgttctacccgcaacggtgttgtgattggctcagcgccgaacaacaacctgtggggtgcttacctgccgcaccagtacagtatttctcacgaagtttctggcaccgcgctgacaccgattctggtgtcaagcgacccgccgtcagacagccgtacagaatttacctacacagaaaccaaaacacacggttttaccattggtggctcatttggcgctgaaggtggcggtgaacacacagacaaatggaaatacattgcaaaaaccccgtttaacattaacgccggtatttcttacaccaacacaaaaaccctgacaaacatcttcaaagactactcactgctggcagccccggcgatcggtaaaatcaaatgggacctgtttatcgacccgaaactgaaatttgttctggtggaacgcgaaaccgcaggcctgccgacactgaacgaaaaccgcatgacaccgatgatgcgtagtgcctctatggaaacctacagtacatgggaactgccgggtaactacgaaggcctggccaccctgaaaattggcggtggctacattctggaccgtcgcgaatggtggtacgaccgtagcgacgtgaaacgtcgctacgaaaccgacacatttgaaacactggacgacattattctggactttggtagtccgtacctgacccgcgaaatgacagttctgattcgtagcgcagacggtcacggcaaatgtgtgggtgaccagagtggccaggcgaaactgctgtcatgcagcccggctgacaaatctcagctgtggggtctggacagtgaatctcgctacgttaaccgtctgagcggcaaatgtctgacagccgacgtgcagagtggtgaactgaaaaccgcggcttgcggcattgacaacgcacagcagtgggactggcgtgctgaccgcattcactctcgttacgaccgcaactggcgtctgtactcaaccgcagacatgctgaaagttattccggacagttctatgctgtttgaagacattccgctgaactcatttaaccgcctgaacattccgtgggcctcttacccgggtgcaccgtcagccaacgacgtgatgccgaacctgaacggtccgtctccgcagatttcaccggactggattggcaaataccacgcagccgacgcacgtcagcgctggaacattgaaattctgcgtgacggcattcaccaccaccaccaccactaataagaattc

SEQ ID NO: 4439 - DNA, 2252 bp, Artificial Sequence
  Optimized for E.coli
ccatggcaacatacggtaccgttcgtgaagcctttaacaacaccgcgattagtccggacggtgaaccgaaagctgctgactttgacgctgctggccgcagcctgagtgcaacagacctggacaaagcgggctggcgtcgcggtacacgtgttacagtgggtgcaaccacatacacacgtgcagacgtggcaccgggtcagccggacaacgtgctggctacaggccagaccctggcaattcagggcgcgggtaacgctctgggttttctggcatcagcaacctcaggtccagttgcagcaccagttaccgtgacatacaccgacggtacctctgctcagcagacactggaagtgccggactggtcagcaggcaccacaaccacagcggctctgagcctggcccaccacaacaccccgagtggtcagcagacatctccagctcgtctgcacgctgttacagtgccactggacccgcgcaaaacagttaccagtgtgaccctgccgaaaacgggtagcagtgcagcaccaggtgctccaggtctgcacgtttttgacctgagcgtgcgtagtaccccgtctgctccgggtggcaaattttgggctggctcttggggtgcatcatttggttctgcacagccagtggcacagccaggttgggcgcagcagacactgcgtatggttgtgaacccgcacaccagtggtggcacagcccgtattcgctttgcgaacaccttttctccgcagccgattcgcctgggtcacgttacagtggctgctcaggcaggtggcgccacagcagcacaggcaccggttagcctgacctttggtggcgcggctgaaaccacactgccggcaggtggcgaaatttactcagacccggttacctttccggtgacagccggtaaaaacctgctggtgagcatttacctgccggaccaggttaccacagtgccgacccacgactacgcactgaccacaagttttatttctaaccgtcagagtggcgaccacacagccgacaccgcagccacagcgtttccgggtaccctgtctcactggacactggttaacggcattgacgtggcggctaccgaaaacattggcaccgttgtgacactgggtgacagtcagacagacggtgctcactctacaccggaccgtaaccagcgttggccggaccactacgcagcagctctgaacgcaaccagtcgcccgacaggcgttgtgaacgcgggtatttctgctaaccgtctgctgaccgaccgcgcggacattgctggtccgtctgcactgagccgtctggaccgtgacgtttttgcgcagagtaacgtgcgtacagttgtggtttacgaaggcattaacgacctggcgcacgacaacgcgtcagctcaggcagttaccgaagctattcgtcgcattagcgcccgcgcgaaagctcgtggtattcgcgtggttgtggcaacactgccggcctttggtggctacagtgcgtactctgacgctaaagaaaccgcacgtcagcaggtgaacgctgcaattcgcacaatgaccgaagcagacgccccgaccgactttgacctggccacacgtgacccggacatgccgtcacagctgctgccgagcatgctgaaaccgggtggcggtgaccacctgcactttggcgacgcgggtaccaaagctctggctgacaccctggttcgtgctgctgacggtccgtcagtgaccatgagccagacagctgcagccgactttaacggcgacggtgctcaggacctggttgcacgtgaagactcaacaggtattctgaaaatgtggctgggccgcggtaacggcacctttgcatcttcaaccgacgtgacagctggttggcgtgcttttagccagacagctgctgcagactttacaggtgacggcaaagctgacctgattgcacgcgacagcagtggtacactgaaactgtggaaaggtcacggcgacggtacctttggctcagcaattacagttaccggcggttgggaatttacacagacagctgctgctgactttgacggtgacggtaaagccgacctgattgcgcgtgactcttcagccaacctgaaaatttttacaggcgacggtaaagcagacctgatcgcacgtgacgacaacaccgctgacctgcgcagctgggcaggtcacaacgacgcaacctttgcacgtccgaccacagtgacaggcggttggcaccaccaccaccaccactaataagaattc

SEQ ID NO: 4440 - DNA, 1217 bp, Artificial Sequence
  Optimized for E.coli
ccatggcagaagtgtgtaccggcacagcctctgtttacggtattctgggcgacggtcgtctgacatactcagccattaacaccaaaggcgaccgcctgaaaacactgattggcccggacctgggttttaccccgaaagcaatggccacactgaactttaacaccattctggttacctctacagcgggtgctctgtaccgtgttgacgtgctgacaaacaacaacgcactggaactgagcggcgttgaaaaaattgccgacagtggttggacccacgacaaactggcgtacgacggctacggtcacctgtacggcaccacagcagccggtaacctgctgcagtacctggtgagccaggacaaaccgcagggcagtcagcacattggtcagcgcaaagaaattggcacaggttttgttctgaaaaccctgacagcgaccggcaaagaccgcctgctggctacagctgctgacggccgcctgctgtcttacaaaattattggttcagcttggaaacgtgacgacctgaaaaacgacggttggagcgcatttgacgaactgaccagcagtggtggcggtttttactttggccgcattccgaccacaggtgctatgtactggtacaaagacggcaacatttctgacggcagcggtagtgacattgtgtaccacacaaacgacccggttgacacatcaggttggacccagaaactgctgtctgcagccccggacaccacatcatgtaaacaggtgaacaccctgggccaggacattgcggctgacgcaaaccgtgaagttggtaacaactttaacgactttgactttaaccacgcacgcgcctggtgcgcagaatttgtggaatacatttgggccggtaactctgttgaccactcacgtgaactggacgcgcgcgctattagcctgaaagaatacggccagcgtcacggtacataccgcaccagtggcccgaaagttggtgacgccgtgctgtacgacgttgaccgtaacctgaacgacggcgaagcggaccacgtgaacattgttgtggcagttagcgccgacggtacacagattcagaccgtgggcggtaacgagagcggcaaagttagtaaagcgggttggtttaactgggacacagcttcatctccagtgggtgctggtccagtgctggcttttgttagtccgaaaggtcaccaccaccaccaccactaataagaattc

SEQ ID NO: 4441 - DNA, 551 bp, Artificial Sequence
  Optimized for E.coli
ccatgggcattgttgactacggttcaggtgacgacgtgccagcagctgacgctgctctggttctgggtgctgctgcttggggcagcaaaccaagtccagtgtttcgtgaacgcattaaccacgccgttaaactgtaccagtctggtaaagttcgttggattgtgtttaccggtggcacaccggaaccgggttacccagctgaagctgacgtgggtcgtgaatttgctgcacgccagggtgttccgatgaccgccatgctggttgaaaaccagagccgcaccacatggcagaacctgagtaacgcgcgtgacctgggtaaccagtttggcattcgctcttacctgctggtgtcagacccgctgcacatgcgtcgcgctgttctgatggctggtgacctgggcctgcgtgcttacccagcaccaaccctgagcagtcgttttcgcacactggcttcttggtcacgttttctggcacgcgaaacatggctgtacgttggctaccgtgtgtttcgccagctgagccaccaccaccaccaccactaataagaattc

SEQ ID NO: 4442 - DNA, 1013 bp, Artificial Sequence
  Optimized for E.coli
ccatgggttctaaccagggcgcctttattgcgctgaaccagacactgtctaccaacgactacctggtgtcaaacaacaacgcatttttcgcaattatgcagggtgacggcaacctgtgtgtttaccgtggctcagcaccagacgctaaccagggttttctgtggggtgctctgggtcagagccagccaaacggtaactactttagtatcatgcaaggtgacggcaacctgtgcgtgtacaaaggtaccggcccgtctgacaaccagggttttgtttggggcgcactgaaccagtcacagccggaccgcgcttactttgcagtgctgcaggacgacggtaacctgtgcgtttacaaaggtacaagcccgagtgacaaccagggtggcgtttggtgctctaccgccattgacccggttgtggacattgaaattagcagtattaactacgacgtggcagccgcgaaaattattaaatcaaccccggctgacctgtaccgtcagtctgttacaaacaacaccgcacagtcacagacatcttcaatttctggctcagaaagcgtgagtgaaaccagcggttggtctgactcactggccgttaaagtgggcgttagtaccacatttaaaacaggcattccgtttctggcggaaggtaaaattagcgtgagtctggacgttaccaacacatacacctggaacggtagcaccacacgcacaaaaacctggagttttaacacaccggtgaccgttccggctaacagcacctacgttgcactgattgctgcaacagtgagcaccattagtgttccgtacacactggccggcaccctgattctgaaaagtggtgcgcgtgtgccgggtattgttcgcggcatgtacacaggttctaactcacacgacctgacagtgacctacattaaacaggacgcgaccacactgaacattgaaagcattacccagccggtggaatacgccaaactggttgcgcaccaccaccaccaccactaataagaattc

SEQ ID NO: 4443 - DNA, 1580 bp, Artificial Sequence
  Optimized for E.coli
ccatgggtaaaaacctggcaaacctgccggttatgagtcaggcaaacgccctggcgcagggtatgaacatttacggcacccgtgacacaagcagttttattaaactgctggttaccccgtcaaaagccccgaacaaaaccgtgacatttctgggcaaagactaccagattccgagctacgtgaacctgctggaaaacaccgaaacatactacgacgctggtgcatacaactctcgcgaagaagttcagaactcactgggcgcgcacgtgggcattagcggtaaatacggcgcttttagtggtgaaatggaagcagactactctcaggcctaccacaaaaactcacagtttgactacgcataccgtaacttttacacccaggttgccacactgcagtaccagtacgacccgcagtacctgtcttcagaatttctgagccgcctgagtgacctgccgtacgaaagcgacaccgacaacctggacatttttagtgaatttttcaacgacttcggtgttttctttacctctaaagttgtgctgggtggcacactgcagttttacatttcagttgacaaacagtctcagacctcaacaaacgaaattagcgcaatggttaaagcgcagtacgaagctctgtttagcagtggctctctggacgcgaacattaaaattagcgacgcttggaaacgttacagtacaaactctaactcaaccctgaaagcgacaggtggcgacccggaaaaaattagccgcattgttatgattgacacctttgaaccgagtaaagaaacagttgaagcttttcacgaatgggtgtcttcaattgcatctgacccggccattattgacttttcactggaaggtatttggcagatttgtggcgacaaacgtcaggcggtgcagagcgcttgggaaaaatacagtgacattatgcacccgcgtatgaccattcgcacaagcagtcaggttattgaatacccgattgaaattgaaccggtgaccccgtcaatttacattggcagccagagttttaaaccgaacgacacaccggctagtccggcaggttttcaggttctgattctgtctggctcaaacatctctgaagtgatcttcaacaaatactacgcgattccgccggttcagtactggtacctgccgagcctggaagtgtgggacgactttgttaaagacgtgcagggtaaacacgactcttcaaacaacattctgattctggttacctttggtctggacctgggcatgacaccgagcagtgacgccattgacgtgctgcgttctgctggtgctggttcaggtctggttaaatgggtgaaaggttgtagcccgccgagtcaggcaccaaccccgtcttgggtttcatacccggccatgtacagtctgaccggtatttttggcaacggtccggacacaggcgttgaatacctgaaatactctggttgggacggcgtgtacagcgacctgagtctggacctgtctatttacttttaccgccagaccttttctggtaactacacatttggcctgggtgaactgcaccaccaccaccaccactaataagaattc

SEQ ID NO: 4444 - DNA, 1232 bp, Artificial Sequence
  Optimized for E.coli
ccatgggctgggaaaaatacggtattcactctgtttacccggcagccatttcagtgcagattaacccgagccagattagtaaccagcagctggcggctattaaagacgcaggctttgaatacgttcgttttggtacccgcccgccggtgagcgacaaaccacaggactttagtgaactgctggaacgtctgcgcaaagctcagctgaaaccgattattaccctgtttggtggcgcaacagtttgggtgcagccgaaacgtatgatgtctgcaaccatgacaccgctggacgcagcagacaactttagtaaatttgctctgaccacactgaaccagtacgcagacccgaacattctgtgggaactgtggaacgaaccggacaacccgacatttctgaaaccgggcatgctgcaggctggtctggttccggcaattcagaaaatttgtagcgcgctggaacagcagaaaggtggtgttaagaaaaacatcttcggcttcggtttcgcaaaactgccgaacctgcagccgaaaattccggacgacaaactgctggccattagcctgcagaactgcctgtctggcgtttcagtgcacccgtaccgtaaaattccggaaaccctggctgacgacgcaacaaaaagtcgcgaactgctgcacaaatacggcaaaggtgaactgccgatgattgctagcgaatggggttacagtaactttacagctgctcgtgaccagggtggccaggctcagctggttctgcgcgaatacctgtctacagtttttgctggcattccgctggtgaacatttaccagtggcaggacaccggttcagaccgtgcagcccgcgaacagaactacggcctgacagacagcagtggtcaggtgaaacaggcactgccagctctgaaacacctgctgggcaaactgaaagacacccagctggccggctctgaaaaagttggtgaagcgtaccagctggtgctgaactctcagccgggtgcggctgcaaaacgttcagttcacgttgtgtggtcatctgctgctcgttctggtccgggtggcggtttttcaattccgcgtaacaagggtcagcgctgtattatttcagaattttacccgcagcagggtgacaaaccgtgtccagaaggtgcaggtagcgttgacattaacgctggtccaagtccgctggctgtgacactgtacgaccaccaccaccaccaccactaataagaattc

SEQ ID NO: 4445 - DNA, 329 bp, Artificial Sequence
  Optimized for E.coli
ccatggcgccgcaggcacacgctgactcttctccggctccagctatgctgctggctcagagcctgccgggttcttcaaacaacaacccgtacaacagcccgattcgtcgcgcaaacccgaacagcatgcagggtacacagccatctgcaccggcagttcgtggcgtgaacccagttccagtgcagcgcccgccgacactggaaaacggtggcattggtaacggctacccgcgtaccattacacagccgcgcattattgacccgaccccggttacaccgccgcgtaaccagcagcagcgccaccaccaccaccaccactaataagaattc

SEQ ID NO: 4446 - DNA, 2174 bp, Artificial Sequence
  Optimized for E.coli
ccatggcagaaaccaacccgcacgctagccacagtgcactgccgtctggccaggccaaagaagcgaacgttacaggtgaagccaaccagcacgaaaacaagaaaaacgaaaacccgtttttctaccagtctcgcctgccgtttcaggcaccgccgtttaacctgattaaagaatcagactacgcgccggctattgacgcgggcatcaaacagaaacgtgaagaagttgaaaaaattgccaacaacccggcgaaaccggactttaaaaacacctttgttgctctggaacaggcaggtgcactgctgacacgcgttatgaacgtgtttggtgctatgacctctgcaaacacatcagacgcactgcagaaactggacgaagaaagcagtccgaaactggcagccctggaagacgctattatgctgaactcaaaactgtttgaacgtattcgcgcaatttaccagcagcgcgacgctctgaaactggacgcagaaagccgtcgcctggttgaagtgacctacaaaaactttgaactggcgggtgctaacctgagtgacgccgacaaaacacgtctgaaagcgctgaaccaggaagcggctaccctgagcacacagtttagtaacaaactgctggcagccaccaaagacggcgcactggccattgcggacaaaggcaaactggacggtctgtctgaatcagaactggctgctgcagcacaggctgctggtgaacgcaaactggacaaacagtggctgctggttctgcagaacaccacacagcagccggaactgcagagcctgaaagaccgtgacacccgcaaagccctgtttgacgcgagttggaaccgtgccgaaaaaggcgacggtaacgacacccgtcagacaattgctcgcctggcaaaagttcgtgccgaacaggcgaaactgctgggctttccgaactacgcagcctggaaactgcagaaccagatggcaaaaaccccggacgcggctctgagctttatgcgcaacattgtgccggcagccacagctcgtgcagaacgcgaagccaaagacattcaggcggttattgaccagcagaagggtgactttaaagtggcggcttgggactggcagttttacgccgaacaagtgcgtaaagcgaaatacgacctggacgaaagtcagattaaaccgtactttgaactggacaacgttctgaacaacggcgtgttttacgcagccaacctgctgtacggtatttcttttaaagaacgcaaagacattccggtttaccagccggacgttcgtgtgtacgaagtgtttgacaaagacggcaaatcactggctctgttttacaccgactttttcaaacgcgacaacaaaggtggcggtgcatggatgagcaactttgttgaacagagtaaactgaaaggcaccaaaccggttatttacaacgtggccaactttacaaaaccagctccgggtcagccagcactgctgagctacgacgacgtgattacactgtttcacgaatttggccacgctctgcacggtatgtttgcagaccaggaatacccgagcctgagtggtaccaacacagcccgtgactttgttgaatttccgtctcagtttaacgaacactgggcgtcagacccgaaagtgtttgctcactttgcaaaacactacaaaaccggcgaagctatgccgcaggaactggtggacaaaattaagaaagcagacaaattcaacaaaggttacgacatgacagaactgctgtctgcggctctgctggacatgcactggcacatgctgtcagccgaccagccgcagcaggacgttgacaaatttgaagcggaaagcctgctgaaagacaaaattgacctgagttacgtgccgccgcgttaccgctcttcatactttaaacacatttggggcaacggttacgcagccggttactacgcttacctgtggaccgaaatgctggccgacgacgcgtttcagtggtttaccgaacacggcggtctgacagcggaaaacggccagcgttttcgcgacatggttctgtctcgtggtaactcacaggacctggaaaaactgtacgtggactggcgcggcaaagaaccgagtattgaaccgatgctgattaaccgtggtctgaaagacgaacaccaccaccaccaccactaataagaattc

SEQ ID NO: 4447 - DNA, 953 bp, Artificial Sequence
  Optimized for E.coli
ccatgggtaaagaactgagcgacccggttctgagtaaacgtatggaactgtaccacaaagttgaagcagtgacccagattccgtggtacgccctggcagccgttgaccagtacgaagaaaacgtgcgtagcaaccgcaaagacctgccggacaaaacaggtattatttctatttacgtgccggacgaaatttggtcaggcccggaaaacccgaacccgaaagacgacgcgccgctgagtattaaagtttttgacggtattggcatggacggtgacggcgacggtaaagcagaagtgagcaacgacgaagacattctgtacacctttgcccagtacctgctgagttacggtacagacgaagaaaacattcgcattggcctgtggaactactaccgtcgcgaccagaccgttggtatcatctctgaatttatgaaactgttcaaagcgtacggtcacattgacctgggcgaacacgcttttccgctgccgattcgtaccgactactcttaccgctcaacatggggcgacgctcgtggttttggtggccgtcgcattcacgaaggtaccgacctgtttgctcactacggcctgccggttaaaagcacatgttacggtgtgattgaaatgaaaggctggaaccgctttggtggctggcgtattggtattcgcgacattaacaacacctaccactactttgcgcacctgaacggctttgctaaaggtattaaaacaggccagattgtggaaccgggccaggttattggctctgtgggttcttctggttacggtccgccgggtacagctggtaaatttccgccgcacctgcactacggcatgtacaaagacaacggcaaaacagaatggtcatttgacccatacccgcacctgcgtgcatgggaacgctacgaatacaaaaagaaaaaacaccaccaccaccaccactaataagaattc

SEQ ID NO: 4448 - DNA, 191 bp, Artificial Sequence
  Optimized for E.coli
ccatggaaggtggcgcggaacgtatgaaacactactgggacaactttccgattagccagcagattccgcgcaccgactctgaacagacaagcagtgaatcaggtaaaaaaccgcaggcaccggttgaagacccgtctcgtaccccggcacagccggacgcccaccaccaccaccaccactaataagaattc

SEQ ID NO: 4449 - DNA, 734 bp, Artificial Sequence
  Optimized for E.coli
ccatggcgaaaaaatcacgtttctactacgaaaagaaaggtgacatcgtttgggaagtgccgatgaaagacgaaaaactgattgcactgacctttgacgacggcccggacccgaaatacaccccgacaattctgaacctgctgcagaaatacggtgcgaaagctacctttttcgttgtgggcgaccgtattacaagttttccgaaactggcgcagcgtgaagttcgcgaaggtcacgaactggctaaccacacatactctcacctgaaagttcgtggccaggaagtggaacgcattgaacaggaaattgaaaaagcagacgaacgcattcaggccattaccggtattaaaccgtacctgtttcgtccgccgacaggctactacgacgaccgcgttgtgaaagcagccaaaaaccagcagtacaccattattctgtggagctggcaccaggacacatttgactggcgcaacccgggtgttggcaaaattgttagccaggtgctgaaccacgcacgtagtggtgacattgtgctgtttcacgacaccggtggcgaccgcacccagacaattgaagccctgaaacagattctgccgaaactgaaagaagaaggctacaaatttgttacagtgtctgaactgctgaaacaccacccgaactacaaatcactgtacctgatgcagcagcagaaacagcacagcgtgcagcaccaccaccaccaccactaataagaattc

SEQ ID NO: 4450 - protein, 100 aa, Artificial Sequence
  Optimized for E.coli
MASFDCKQARQADERAICASRALSEQDVEMSVRYEMLMGLVAMGTRGDMGEAQQQWLKRRARCGASQSCLATAYRERIDALKQQYRQLQSRGPFHHHHHH

SEQ ID NO: 4451 - protein, 551 aa, Artificial Sequence
  Optimized for E.coli
MAESDGQAPQTAAASSMQSYVEAMQPGWNLGNSLDAVGADETAWGNPRITQALIQQISAQGYKSIRIPVTWDKHIGAAPNYTVESAYMNRVEEVVRWALDANLYVMINVHHDSWTWVSSMEPKHDEVLARYNALWTQIAQRFKEQPNKLMFESINEPRFSEGGTTDEAKMNQMLQELNVSFHKIVRASGGKNATRPLVLPGLDTSPAQAKINELYNTITKLNDPNLIATVHYYGYWPFSVNIAGHTTFDKDTKNDIIQTFDNVYNTFVAKGIPVIIGEYGLLGFDKNTGVIEQGEKLKFFEFLTYYMKEKKITGMLWDNGQHLNRTTYKWSDPELFNVIKSSLKGRSSNAASDLIHLKKGTPAQDAKVILNLNGNQLKTLSVGSKQLTQGTDYALSGDTLTLKASLLTSLTTSGKYGENAVITAKFNKGADWNFRVVVYDTPKLSAIKGTTQAFSIPTDFHGSQLATMEAVYTNGGNAGPQDWTPYKEFGNTFAPAYDANGIKLLPELFNSVKDGDVTLKFHFWSGDVVTYKITKSGTRVTGTTSHHHHHH

SEQ ID NO: 4452 - protein, 259 aa, Artificial Sequence
  Optimized for E.coli
MASAQTIKVKKGDTLWGLSNRYGTSINSIKSENKLKSDIIYIGQTLSINGKSSSGSNSGSKSSSSTYKVVKGDSLWKIANKYKMTVNQLKSLNGLKTDLIRIGQVLKVKGSTSGSASSGSSSSKKPSSSHNIAQTSLNVNKLVSDAQSLIGTPYVWGGTTTSGFDCSGFIWYLLNKQTSVGRTSTAGYWSSMKSVSSPSRGDFVFFTTYQAGPSHMGVYIGNNKFIHAGSDGVTTSDLNNSYWKPRYLGAKRFHHHHHH

SEQ ID NO: 4453 - protein, 85 aa, Artificial Sequence
  Optimized for E.coli
MAGNDQSLSQYVKIKVQDGDTLWSLADHVAEKKHINKEDFIEWVTENNHLQTADIKPGDELILPVKKKHPAVYQLAIVNHHHHHH

SEQ ID NO: 4454 - protein, 440 aa, Artificial Sequence
  Optimized for E.coli
MAGPDTSRHQAQIDQIVKDISPVRIEGYINKLVGFRTRHTMSDTVSETEGIGAARRWIKSELERCGAAQGGRLQVAFDSHIAPVSARISRPTEIVNVVATLPGTQAASVDRMYVVSGHYDSRNTDVMDAKGDAPGANDDASGTAAVMEMACVMAKYKFDATLVFMTVAAEEQGLLGAAHWAELARQKNLNIAGMFTNDIIGSSRDEHGKVDNTQVRLFAEGLPVQKENSDAVRTLIQTGGENDSLSRQLARAVKEAGERYVPKFKVNVIQRRDRYLRGGDHMPFLERGYAALRFTEPAEDFNHQHQNIRTENGVLIGDLPQYDDFNYIAQVARVNAAALSSLSLAPAAPAKVQVRTAKLQNDTELVWQANAEPDLAGYRIVWRDTSAAEWQGSQFVGKATEFTVPLSKDNYYFGVQAIDTEGNASPASYPTPLRHHHHHH

SEQ ID NO: 4455 - protein, 372 aa, Artificial Sequence
  Optimized for E.coli
MASVKGYYHTQGNKIVDESGKEAAFNGLNWFGLETPNYTLHGLWSRSMDDMLDQMKKEGYNLIRLPYSNQLFDSSSRPDSIDYHKNPDLVGLTPIQIMDKLIEKAGQRGIQIILDRHRPSSGGQSELWYTSQYPESRWISDWKMLADRYKSNPTVIGADLHNEPHGQASWGTGNASTDWRLAAQRAGNAILSVNPNWLILVEGVDHNVQGNNSQYWWGGNLTGVANYPVVLDVPNRVVYSPHDYGPGVSSQPWFNDPAFPSNLPAIWDQTWGYISKQNIAPVLVGEFGGRNVDLSSSEGKWQNALVDYIGANNLYFTYWSLNPNSGDTGGLLLDDWTTWNRPKQDMLSRIMKPVVFVAEQAKATAEHHHHHH

SEQ ID NO: 4456 - protein, 483 aa, Artificial Sequence
  Optimized for E.coli
MAASSVGTVKGDNVNVYRSPSLHSSIVQTVKKGEEFPVISSEAGDAAQVTTHTVVPGNTLWLLAKQYGVTVSDLIKQNQLKKTELIPGQTLKIPAKGLLHKVVSGDTLWKISVKYGVKANELTKLNQLSSTNIKPGQMLIIPDYYVQVQLLEGKKGWIKKSDLAQKKHQPVVMGWSFNEKAAGYTESMKQKNLDVVSPRWFTLTSNDKVVSSSINESYVQTAHKNGKKVWPLIGNNFDDVLTSDVLSNKAKRQKLVSSVESSLVKTKSDGINVDFENINIKNKQDFVLFIKELKAALKSHGMTVSVDVTRENNDPFWSGSFDRKQIGQVADYVIMMGYEEHWGGSQVPGSVASLPWVKEGTQLLMKDVPAHKILLGVPFYTREWKTDLSTKKVVTKDLTMKEAEAVISSKKLTKKWDSQTSQYYVEYTENGTKHQIWLEDKASMQRRVNLIKDYHLGGAAAWYIGSETSDIWELYNFHHHHHH

SEQ ID NO: 4457 - protein, 313 aa, Artificial Sequence
  Optimized for E.coli
MEQAEASVNYDHIVPAAKQYIGVPYRWGGTTAKGFDCSGFIRHVYQSIGIDTPRTATDMYRMGKRVDKSALRVGDLVFFNTSGKGVSHAGIYIGNNRFIHSSSSKGVTISSLNDSYWKKTYIGAKRVLAYRLAPGQFQDVSPSHWAFDEVRTLSEQELVIGYEDSYFKPDEPITRAEVAAYLAEYLDLNLSDRSVPFNDVPDDYWALGAIRAVQKQGIMNGSNGKFHPEDTLTRAQLAAVLTRAFRLQPPAAAKSFTDVPPSFWAFRDIQALAAAGIATGRTDGSFGPNEPVTRVQFAAFLYRAMHQHHHHHH

SEQ ID NO: 4458 - protein, 1592 aa, Artificial Sequence
  Optimized for E.coli
MENARAHGKATRAGKLPAALGSTLILLSGAMLIAPTVHAANAADATVTLGSGSVSTVGNTTTIKQNSQNLAIDWVGLSTAANEALIFNQPNSSAIALNRITGSSPSTLLGSLTANGQVFILNPNGVLFGAGSQVNVGGLVASTLGMSNADLQAGRMVFALDGNTNGSVVNQGKINAADGGYIALIAATVRNEGEINAKLGTALLAAGNKVTLNINNGSLLAYSIDQGALNALAENKQLIQANGGQVLMSAKALNTLTTAVVNNTGLIEAKTIENRNGRIMLMGDMEVGTVNVAGTLDASAPTSGNGGFIETSAAHVKIADDALITTRANSGTSGSWLIDPVDFTVAASGGDITGKALSTQLANNGLVTIMNTQGASGTAGDINVNDTVSWSSNSVLELIAQRDINFNAAVTATGTTAGLKLTYAGDYKVKAPITLSGSNSTLNINGNNYTLIRSMSQLDLLDGSNSVTNTGTARQLNGYYALAQDLDAAGTTYTKSLLGSSSSTTFLGTFAGMGHTISNLTINAAGGAGLFGLIGAGSVVRDLGMVGGSIYGANGDVGAIAGRNSGGTINNVYATGMMVGGTTRIGGILGYLNGGTLSNSYSNVTVVGGNSSSGGLVGTNSGSISNSYAEGEISGGGLVGGLVGTNNAGASITQSYASGNVIGNFGGSRAGGLVGLNSGAISYAYASGAVSGDSLVGGLVAWNYPGGSISNAYASGNVTLVVNPALSGTYAGGLIGSDSSTTTNAVWDSSSSGHVSYTGTIGSATNTTDVNAGNRYQHSAYSALGSWQETATGSGVWIAYDGSNNPQWVMVEGSTRPFLYSEWSTTVGNAHQLQLMAANLSANYTLAKNIDLSAAHGSNASGMWNATGFASIGNSLAAFSGTLDGKNYKISNLQIIKPTSDNVGLFGVTAVGSKVQNVGLVSASVSGQTQVGGLVGYNRGELSNVSVQGQISGGISVGGLAGLNMGTINASYGNAVVSSQSGFVGGLVGSNSGRISNSYADGNVSADRDVGGLVGANEATGIIEGSYAAGQVNVYQAGGGLVGSNRGTISNSYAMASVSGVAIAGGLVGVNDGTISNSYANGAVLVGVAGGGFIGMNNGAVNSSFWNSDTNSTGVGAGVNTGVTGINHAQAQLASTFVSAGWDMGTTGGTSTIWRIYDGLSGPLLRSFLTPVTVSATVNSKTYDGSGTMANGYTPVAGVTLSGSLVFTSSKNAGSYSSSDGTLQQGGLSSTQQGYDISYADASLTINKANLTVTAGSASKTYDGTTTASGTINVGTLAGAGDLVNSGGSLAFDDKNAGSGKTVIASGVTIKDAANGDVTDNYNISYVNNTSGSIAKANVTLNVTDVTKTYDGTNNAAAALAVQSGQLYGLDEVTAGSFSFNNKDAGNNKTVSASGVTVNDGNNGNNYNVTVVDSSNSTINRAALTVTANDANKVFNNLAYVGGNGVTLNGLVHGETIADLQGALAYGGTAQGATGAGNYIISANGLSSSNYAVTFVDGTLVIRPAVSVPTGVVPGELLPAYQTAIRNSDSDLRQNNDGKDEDLKVAAFQPPIEKNDAADAARPTPRLTISSCGLQLPADAGNSVCQHHHHHH

SEQ ID NO: 4459 - protein, 239 aa, Artificial Sequence
  Optimized for E.coli
MANIAPVKANNVVLVHGSWADGSSWSEVITRLQAAGLHVTAVQNPLTSVANDVAATQRVLDQQDGPTVLVGHSYAGTVVSEAGVDPKVSSLVYVAARAPDAGEDFVALSGKYPTMPVRAGTEEHDGYVSLKQDAFLKYFASDVPHDKAMELFAVQQPIAKTLFGERTTAAAWHTKPSWYAVSSLDQTINPDLERFLAKRMGATTIELPSSHLSLVSHSKEIADLILEASGRQPHHHHHH

SEQ ID NO: 4460 - protein, 315 aa, Artificial Sequence
  Optimized for E.coli
MGSTKQDQLVTEAKKHIGVPYRWGGTTTSGFDCSGYMQYVFNQIGINLPRTTSQMYNTGTSVSKSNLQVGDLVFFNTSGSGVSHAGIFIGNNQFIHSASSRGVSISSINDPHYWGSRYIGAKRVMTNTPVRSLGSGEFYDVATNHWAFSEIRQLSNNGIIGGVGNSNFAPTDQLTRAQIAALVVRATNTPLTTTANGFNDVSQSHWAAADISAADRAGFFDHIQGDSFNPNANVSRAEIAVIFSKAFDLQANGSSASAFSDINSSNWAYNEINALHSNGLVQGFTDGTYRPSSSISRAEFAKILHGALYHHHHHH

SEQ ID NO: 4461 - protein, 253 aa, Artificial Sequence
  Optimized for E.coli
MGSSTVVREPSRGGGRPSASRPSGSRPAPPPASRPKYGATVTVQRGEGLYRIATNNGIQLADLAAWNNLSPPYNLYPGQRLRLYPQSGGRPSSGSVSAGSSVAGGTTAPRPSTPPPAPTASVDSGIRWRWPSDGPLLGRYLANEPTKQGIDIGGASGAPVRAAADGVVVYSGTGLVGYGELIIVKHNEQWLSAYGHNRKRLVNEGQLVKAGDQIAEMGRSGAARDMLHFEVRYNAKPVDPMLYLPAKHHHHHH

SEQ ID NO: 4462 - protein, 162 aa, Artificial Sequence
  Optimized for E.coli
MGSIEVGSKLQGKVTGITNFGAFVELPGGSTGLVHISEVADNYVKDINDHLKVGDEVEVKVINVEKDGKIGLSIKKAVDKPERPERPERPARAPRSDRPRDSRPQRNNNRGGGNDFRTKETFEQKMNRFLKDSEERLSSLKRHTESKRGGRGAKRGHHHHHH

SEQ ID NO: 4463 - protein, 300 aa, Artificial Sequence
  Optimized for E.coli
MAENERAAPTVESSSAPGSPSEAATTATSAAETGGSQARESGESAADEQRTAVAVAAAPAIPARTASGVDSGRPRKPVLAVAGIVGAALIAVPLLLAGGVDEDKRPEGPKELAAGESDTVLDPGSAGAALDDYVAEKPTPTPTVEKPEPSAPVKAVAPPPAPKPEPTTSAPAKKVMPKPKAKPTPKPDWTASTVRAVSTLEVSQAWTTNRIRMVMQPDGNLVVYNEKNKPTWASMTFGENHRAIFQSDGNLVIHNGDDRPIWASDTWGNEGAELILREDGKVVIARSGKVLWSTHHHHHH

SEQ ID NO: 4464 - protein, 103 aa, Artificial Sequence
  Optimized for E.coli
MATDAAAAAPINRTNCNQNDYLEIHNNNGRDTLCFANAGEMPVAIYGVNWVESGNNSVTFQFQRNESDPRIETVTLGKWSQWNPGQPYLHKILWIKIHHHHHH

SEQ ID NO: 4465 - protein, 1686 aa, Artificial Sequence
  Optimized for E.coli
MGPEPILRPVMPVARDLHLDLLKARVPGWYSAAIVQRQRELSDHTLELPDWYAKAPYETRASLKSSHSRYREILNQVDNVLGDIQDIRAFAEPLLEQAIKAEFKQTLDVNQVYFVRKYGRQVRGDFFGALVLDKGDSQFNQYEYHGSSLLEAALANFEPDEENRPGCADCTLITTQRPFYGGEVMPSTSAFRAGALPIAPQAFARLCRTLDLGRLYQEHINAIVRPPNEASRNQLDRQLRDHHRQGLALSMEIARAKGDISQAAFRMLQQVVGDQDAITLDDRAVTFTSLKVFDIELVGPLLIGPERENSRRVERLVAYLPGDPEQPLKEFASSADFMAQTRRRLRGIGYRRFFSRFVPLRKQGVFFEQFNRLYQPSEQENSLVDYPLKSNLRRLPMDTSPIPAPLWESLRLRQVQKIQLDARAVAVPTGDEDKKARLARQESYLNAVIDVLNLGAFVVPGLGPLMLTVGAVQMFNEAFEGIEAFERGETREMWAHFSSVALNTAFVATGAAVLPHIQWSNTVEQLEPLRLNNGEARLWRPDLAPYRSDLVPSAGAVPDARGLHRVNGRPILALDGRHYEVQLEPATQRYRIRHPSRPEAYQPKLTDNGSGAWRHELEHPHGWAGAKLMKRLGHRVEHFSTAELEQIRIASGTGEDVLRRMHIEGAPMPALLADTTTRFDICRQIETLTAQLQSEEALDYDKAEPMTQLHLLTRYGPWPKGLQLEVVDRSGRRLWHYAPDPQAGAAARGVSLAEANVRTPSVLKNLIEAVDAAGGDLLADASPAIAKTDMPARVRQLRKQLAEIVVREKVSLFNDYYAKQDLSSDPRATLIKSRFPSVPAAAIDQMLALATSAETQQMDAWDFADAAQTKPIPLRIAEELRHFQRTVRMNRAYEGLYQEPLATADTPRLALATLETLSGWSDTVRIELRADDLTGDLIGAIGPQGAQQTKYVIKDGGAYKSLDDQGNDLSHWGSLYDALQRALPDAERQAMGRPSIHQGDLLKQAIGAAPASRDSLASLLKLPPVMPSYKSPMRLASGQVGYPLGGLRERLGLSRSPQSRVLELYPDYTEQEVQALLEAFGDGAVGELKRRKVELQMLDRDLDLWANTPGWREVGRQRHQLVEPQARRAVAERIKRCWRRQVPVVTAVDGSRVGYELVLSQQYVGELPDLTANFSHVASLKLNDMGLTREGSESFLTGFSSLRWLDMTLNRLTDVPAALGAMNGLTRLQLGSNQIRLTSRSVGTLQDLTQLKILNLENNPLDRLPDFSHFPALRGLYLKSTDISVWPRGLGELPLERVDLRDNRLTEVPDDLIDPPPARALITARLNGVTLLQGNPLSELTQQRLGEYWANISLTHPQWMALRSPGAFGHALPGRPSNVQQWLRNLPSNELEARKDLWRSLAREPQSKELFRLLNRLAGSYQGEENYPDLQARVWQMLEAARDSTQLRRELFELAGAPACEDRAALSFSYLEIRLMIHNARALAGGTDEAAVLVRLAKGLFRLDEVERIALQDIQQRRDAINARRDLTAAQKAQHLQQIEEVEVRLAYRVGLKGRLELPKQPAGGRFLMLAGVTQEALDAAAEQVLALDDSPEQFQSLVGRDFWIDYLKEHHPTSFQALTDTLIANQIELDEAKAAGTLEAADYASQSEALALQFKVKEAELIQSLTQSELDALPESTELHHHHHH

SEQ ID NO: 4466 - protein, 497 aa, Artificial Sequence
  Optimized for E.coli
MGADAAPESAVFQHKGKARFASKFVSNPNIAGSLNDVLKGSNPEVKKAVSQNILSGFAADVLLKNWDVVGLEFDNILVTKDKKAIRIDNGSAFLSRAMGERKSPASLSELDEIQGLFKPSVNASYAKIAAHAGCASIQDIPNFPQQVKSIVDLRNSGGTDSWRPLVTAWTPGMARRDQDAIINMLDVRTEKLKQLVASPSTQSTGISAKDMKKASGDLDDGIKLKTVIDEYLGPKPKKEDMQKIMQVYNGMVQKIIQHPEVANSDVFKLIWNNPNLLKEGDFEEINPHDTNPHDINSLFKVTDNLKESSDGEFDNCNKGEMVSTLLYTTGLSNKINTALSKNDVPTLNKLSPILNGVSSMIGKGPGYSGKTYRVKEHDGAVLQGFYNAYKNNTAINVPCFLSTTKDKGLARRWEKNKPNESDFTGNTCFHITVPAQVHANGNKARDITKLGEEEEEQEVLFNHHTNFVVTDFKNIGDNKIGNKYLISLTAVHHHHHH

SEQ ID NO: 4467 - protein, 433 aa, Artificial Sequence
  Optimized for E.coli
MVKQGDTLSAIASQYRTTVSEITETNEIPNPDSLVVGQTIVIPIAGQFYDVKRGDTLTSIARQFNTTAAELARVNRIQLNTVLQIGFRLYIPPAPKRDIESNAYLEPRGNQVSENLQQAAREASPYLTYLGAFSFQAQRNGTLVAPPLTNLRSITESQNTTLMMIITNLENQAFSDELGRILLNDETVKRRLLNEIVENAKRYGFRDIHFDFEYLRPQDREAYNQFLREARDLFHREGLEISTALAPKTSATQQGRWYEAHDYRAHGQIVDFVVLMTYEWGYSGGPPQAVSPIGPVRDVIEYALTEMPANKIVMGQNLYGYDWTLPYTAGGTPARAVSPQQAIVIADQNNASIQYDQTAQAPFFRYTDAENRRHEVWFEDARSIQAKFNLIKELNLRGISYWKLGLSFPQNWLLLSDQFNVVKKTFRHHHHHH

SEQ ID NO: 4468 - protein, 92 aa, Artificial Sequence
  Optimized for E.coli
MGIDHVTCNPGAGYLKIWSHLNGRDSVDCYANRGKTNFGGWWVDKISTGNNDVKYYDANGDVVKINRHKVISFPNRPPKVKAIEILHHHHHH

SEQ ID NO: 4469 - protein, 100 aa, Artificial Sequence
  Optimized for E.coli
MGDNDPQKKKAADADSSQPVSDTWITTKVKSSLLADSDVSGTKIEVDTVDGVVYLTGTVGSQAQADEAKRIAGEIDGVAKVDTSRLKVDAQASRHHHHHH

SEQ ID NO: 4470 - protein, 319 aa, Artificial Sequence
  Optimized for E.coli
MGSKKDKSQYPPPGELVDAGGYRLHIRKLGNGSPTILLESGSGESSLSWRDIPEKLSSFATVVSYDRAGYAWSEEANTPRTGENIVRELHTALKNADIRPPYILVGHSLGGMYSRLYAQTYRDEVAGLVLVDARPENDARRTNKIYAKERPKANPSPLISILLEKSGAFRLFPNFMLTGRVEYQDRKSFVNIVASSKYFRSVAEEGDLASTTEDAIRGQHLGNLPVRVIARGIQQDLTQFGISKRGNDQIEQSWQMGQREMLNISTNSKLIVAKKSEHMIIHDQPKLVIQVIRELITDTSHFQSTTSKAFTDDHHHHHH

SEQ ID NO: 4471 - protein, 437 aa, Artificial Sequence
  Optimized for E.coli
MGCEDDASPALRGSQCALMDVPLRHADPSGEHISLFLRRIPASADTTRRGEVWLLSGGPGESGASLYPLIQTYQRAFPGFDLVIPDHRGTGRSSRICPVQESPESPEGTGLAGTEWGPCIGAMYANLQRTSAFSITEAAQDLGILMSDADRSGPVLLYGVSYGTQLALRALQVNDLRVDGLILDGLVPPETTETFDLSRRTALVDQVGRDSMDERSLERYRTLLAVKDAGWQKEVPGGDVRRFFAALLSFPALRDRIPRIVQDLSAGDDRSLVATVKDWNVALAQLGQGGNNQPALPLVMLIAASENNARPELGMATVNEEAKDALFVSPIPDLLVNGSVPRYPRDAWFGTSPRTLPRTLVIQGTLDPNTAYAGAKEHAATLGRSGPVTFHTVDRGAHLLALVAPRCFVAAVDSFIEGAVISERCAEPTPEHHHHHH

SEQ ID NO: 4472 - protein, 246 aa, Artificial Sequence
  Optimized for E.coli
MGTQTVDGQPYHFGFKKSKGGELPSIAQEGFMQLIERQGGIFLGDTTKKELFLTFDNGYENGYTPKVLDVLKAKKVPAAFFVTGHFVKDQPDLMRRMASEGHIIGNHSWSHPDMSTISSTEIRSELDRVRNASAELTGQKEMKYVRPPRGIFSEKALASCREAGYTSVFWSVAYKDWDTNIQQGTDYAYRQVIGQLHPGAVILLHSVSKDNAEALGSIIDEARKQGYEFKSLDDLKVKHYHHHHHH

SEQ ID NO: 4473 - protein, 560 aa, Artificial Sequence
  Optimized for E.coli
MGNITAQQSATILKAFSDASATDFRQFLGSVAKSELAKTANLGPAISAFLDNKTLSAEQQNEINRLLGIYARVKYGNAATETLRELVAIPTFQVEGVAQHDNPEFIKIADKIKGLAQAFNLNFRNIDNRVYEISLEGSGDEVVGIHAHADVVPVTPENWVLKDGTKLDPFKVTLIGDRMYGRGTEDDKNGIVVAMYAMKVIKEEKLPLARNFKLLVDTTEETSGDAIPYYFEHNPTPNYNLALDGGYPVVIAEKGYGTVMGNFPRRDGEGKGAEIISMTGGMATNQIPSASVAVLVTDKPAELAASLQKAGADYAKRNGGNFEVNAKVDGKDVKLTVTGVSAHSSEPESGVNPVARMLDFIHSIDGKVALKHNHITDAARYAADNWGLDYLGGKLGVGFSDAFMGPLTTSLTFVGMDDKTFKLAVNLRVPKGESPEALKAKIADKIGAWSKKTHVPATFTYSIAEPMYRNPEGEWVKALLAVSTENLGMEHKFGSSAGATSVHELPNGVQFGLARPEVKYTGHTDNEFKTVDQFLLDLQIVTEMMGRVGQLPKLHHHHHH

SEQ ID NO: 4474 - protein, 330 aa, Artificial Sequence
  Optimized for E.coli
MVGEGPNYDGNGQITTSKLATYDQMVSFLKDQDARQSAMELEVIGQTVKGRDIHLVKYISDPAKPTILYLTQQHGNEQLTTEGALEFVKHLGTGKSADILDGVNILIVPMLNADGAMGDVNFPLDDYLAKGDRNMTRYNAEEVDLNRDHVAKIQPETQALHNNVMRKYNIDYMIDLHHQGTRSERDGELVSGSILYPTTPNANPAVVEKSKQLGAVVFHNVDSTGWGHLGKYVGGSAETISRNGIAVEYGIATLLFEMRGMSDHYLDGYALGLRSNGYLIKQTVTTLTATAAAIADGSIAGADTSFWDSLATQTSRPGGEADDEHHHHHH

SEQ ID NO: 4475 - protein, 445 aa, Artificial Sequence
  Optimized for E.coli
MGSNNPLLELMYRGESGAAGYNAYNRGTYTDDAGKERIRGPNGPIDFSQMTLGQVMDRQALPNGNDDRVFAVGKYQIIPQTMRGAVAEMGLDRNQPFTPALQDKVFSEYLIVDKRPEIADYITGKPGATLAEAQHGLSKEWASFGDPNKNGASHYGGANHASITLQQSADALNQMRTEYKANIDKGLSPADAWKATTGDDPNRTLPASITSPGSSQRAPRDAMADGVLKPDERGPAVTSLQEQLNKAGFRDAQGNELKPDGHYGKHTKEAVEAFQRANNLEVDGKAGPKTLEALKNAQPAGPQTEKPAEKPGEVQLSNPAHPDHAMYKQAVAGLEKLGPQAGFKDHAALERAAGTMTYEARVSGMTKIDHVVPNASGTGLFAVQGELRDPASQRVVVDKAQASSQSIEQSTQQLKQDAPTQNQTQEPAQERQQPKTMMAHHHHHH

SEQ ID NO: 4476 - protein, 571 aa, Artificial Sequence
  Optimized for E.coli
MGNNDGVTNLALDPTSSAQSDIISDAVYKITAQHSGKNLEVEGGSKDDGANVQQWTDNGKEQQKWRVVDVGDGYYKLISQSSGKTLDVAGGNTHDGANVQQWTDNGNAQQKWKIIDAGGGYYKLISQSSGKALDVVGGYTHDGANVQQWADNGSAQQRWRFTQIDTTADTTPPTAPTNLQSSSKTSTSVTLTWTTSKDNVGVTGYVIYNGTDLVDTSTTTSYTVTGLTANTSYNFTVKAKDAAGNVSEPSNVLKVTTSSDSSQNTGFYVKGTTLYDGKGNPFVMRGINHAYTWYKGQESVAIPAIAKTGANTIRIVLSDGQQWTKDDLSALQNLITLSEQNKLVVILEVHDGTGSDNAAVLNKIADYWIEMKSALIGKENTVILNIANEWFGTWDGNGWAQGYKSVIPKLRNAGIKNTIMVDAAGWGQYPKSIFDYGTQVFDADPLKNTMFSIHMYEYAGGNAETVKSNIDNVLNKNLAVIIGEFGIKHTNGDVDEATIMSYAQQKGVGYLGWSWKGNGSGLEYLDMSNDWGGSSYTEQGRAIIEGPNGIRATSKLSTVYSSGKQHHHHHH

SEQ ID NO: 4477 - protein, 138 aa, Artificial Sequence
  Optimized for E.coli
MGTESRRPYGAPQPEPIDDNEDRMGSMEELDFDEEEPGARVGDPASSSVEHRTPHRHIHGSSLTGNAEDEPNDDDLTPENLIREDGARSAHEAGEDQPADWDLSIVDEDDIGGGNGLDEAELAQRDPLDGKPHHHHHH

SEQ ID NO: 4478 - protein, 145 aa, Artificial Sequence
  Optimized for E.coli
MGSWRKSTQFGGDGGSPFSDDLTNVKRLAGFYIRHGSRIDAIQGIYEYSDGRRTPQGFHGGYGGSHNIVFFENDEYIIQITGRTDRRVDQLTFTTNKRTYGPYGGDGGNPFEIDAAHISGFFGRSASELDAIGFFIPTVHHHHHH

SEQ ID NO: 4479 - protein, 109 aa, Artificial Sequence
  Optimized for E.coli
MGPNQGGSSFTNQGFKASTGNQFKAEFAQDNTVGVVSQKVKQSEQNKIQDNFQTPNEKYDEEFATDQGGTGAVAQKVQNSSRNKIQNNAQTPNEKFDENFNTKHHHHHH

SEQ ID NO: 4480 - protein, 170 aa, Artificial Sequence
  Optimized for E.coli
MGKGFTPGLFDRLMGGDNTPAQSDLVVRLSMDALKDTVARDLEAMLNTRTVIPEELLKNFPECSKSILTYGLNDFSGMSLASLDDRAHICQCLEQGIARHEPRLRNVRASLELREGSINRLNFAIAAMLVVGPAKEAVSFDAVLQPSTLQYSISRARRAMRMDGHHHHHH

SEQ ID NO: 4481 - protein, 165 aa, Artificial Sequence
  Optimized for E.coli
MGTTSYCGLVWGSLAETDQRFSKTTVTNVRTGQHYCFDRMVLDLKGPATGYNVRYVPRVVQDGSGFTVPVRGGARLQVTLHAPSYDPYSGEPTYNPPANQAELSNVANYQTFRQVAWAGSYEGYTNIGLGVRARLPFRVFTLDGPGSNSRLVIDVAHFWHHHHHH

SEQ ID NO: 4482 - protein, 309 aa, Artificial Sequence
  Optimized for E.coli
MEEHGTPVQKTIDLNEGFDNSNEASTEPLSLTSEEATSQATVTAIDHDANFSPSTLQFLKANTGLDGEQWDNIMKLVNKPEQDSLKWTEFYGYAEDIGDNRGYTIGIFGATTGGSNDTGPDGPDLFKAFDAASGASNPSIAGGLTRAGLKGKMSGSILKLSDSDSVIKKKINALQNNEAWREAMWRTFYDTYIEYSVQQAQKRGFNTALTIGSFVDTALNQGATGDSGSLEGILSRSGSSTNEKKFMTSFYAKRTLVVDTNDYNQPPNGKNRVKQWSSLLASGETDLKNADAAVIKATNWELKHHHHHH

SEQ ID NO: 4483 - protein, 489 aa, Artificial Sequence
  Optimized for E.coli
MAPASAAPTAQATRYVSEAGVTAHRAAVVNAAAVKAQVPSTANPLPGLDPAGDPANLSVLVNKSRPLNPATYAPADLVNARGSGQYLRAEAAAWLNGLFQGAADAGTGGLAVVSGYRSYAQQQQVYSSYVNLYGQAQADLISARPGYSEHQTGLAVDVGNANGSCGLSTCFGDTAAGMWVAANAYKYGFIVRYPNGYTNITGYSYEPWHLRYVGVDLATDMKRRGFATLEQYFSGNPSVHASITSGADLVAADAAGRLLRYPALPSGGYGVPVQIGSNWTGLKQAFVVDWDSDGVYDLLAQWNNGTLGLFKGWPGGAFSTQIVVGTGDWDAMTITVGKWSSDQGYPGVVGYFPDGGLRYYPNTSGRALTYRVDIGTGWAGLGLTMADWDADGANDILATTSSGLLLSYPGNGVGGFKGQPSIIGSGWGTMKALVPGFGLSGPGTRSITAQTVDGYLVDYGLGLGVWGPQRQVGNGWGSMKLFKHHHHHH

SEQ ID NO: 4484 - protein, 154 aa, Artificial Sequence
  Optimized for E.coli
MVETLDGKVIEKILILKSSHQLQLINDGRPLKTYRISLGKRPKGPKLMEGDKRTPEGFYWVDWRKISDRFNLAMHISYPNISDSARARREGVEPGGMIMIHGTPDSEDTPEDLFHTLDWTDGCIAMRNMDMREVWNLVPDGTMIEIRPHHHHHH

SEQ ID NO: 4485 - protein, 161 aa, Artificial Sequence
  Optimized for E.coli
MATSYCGLAWGSQDKTAPEMSSASVTNVRTGQQPCFDRMVVDLNGPVKGYTVRYVPEIIQDGTGFTIPVYGNARLQVVVNAPSYDSNGVTYNPAAKAELSNVAGYQTFRQVVYANSFEGSTSIGLGVRARLPFRVFTLDGPGSGSRLIVDVAHFWHHHHHH

SEQ ID NO: 4486 - protein, 833 aa, Artificial Sequence
  Optimized for E.coli
MGNDYQSEIALIRQSNSLEDIASIARQHAATTEKEGGILYSRPIGKVSSEGAAVSLSKETGLPIINDTPRANFLSDEDVRSSIEKKAREIFEDLGHDPTTARKSANSFLYGDPNVPSQDPTSLSRCLWGEASQEFASSLRGDIKVVASAANLERVFGQVEVPAVLNNPNVTSLGGQPVPKLQALYAQGGASAVLPEVQTQFIQAAPKGIFTTAESIGNEVKDVTFSREFAGSFDLKETHFRSSAELSASGMVRAPTGLDVPAANLAETALTAEAAASRRLSPGTVRGLGVVGAAAAVYDLGGTVRNTERLDAQGNSTAADAEVTRYATRNLGTFGGAMLGSSVGAALGVESGPGLLVTGAVGGIVGAVGGDKLADVINDHRISHQQDAQGNTWRLENHQAGERWARDVSTGEIDPAAVAFGEAGVPLYKTRTELATPEVADLLTFKASRTSIELALGSPPQNKDPYTQPAKEHDTRSLRESPWLHNANTQQWTRQVADGLIDRTMSTHTETASPQRASQLDEASRQIIKQNAMHTPAAMAAHYKETYEQNGWERHAYMPAAVHDALKHPGRIVGSDGDLYERGKDGQWTHDGMLWDSQAKGNLKQELDGTYAAQTLGTQRTAAQPVAQTAAEPIKTLETIHVTAPRMQNHDNADTSSKKTQEDTDVRGHSAPTRPQASGPQDPDHPDHPMLKQIREGVAKIDESVGKPYDEMSERVSRCLLAACKDNRERYPEAGNTSLAANALQRVDHVLMGKNGNLVAIEGRIDDPTHKRAAIPIDQAINMPLEQSDAKLQAANQAIAQEQTQTRQQELARSQQQDTQQAPRVSFHHHHHH

SEQ ID NO: 4487 - protein, 221 aa, Artificial Sequence
  Optimized for E.coli
MGELLLFSHEDFRGERVTIADGAASNFTDFGFNDRASSIVVRSGTWELCEHKDFGGQCAVFERGEYPNLRQFNNQFSSAREIQGGRRDRGNSGYGYGRDDRDYRDYRDERREERRDGRWMEDRREERRDYRERGDAVEMYNDVGFRGRHVVINNDMHTLRDVGFNDNANSLVINYGTWQVCEHADYGGQCRTYGPGRYPNLEDFIDRISSIRRVRHHHHHH

SEQ ID NO: 4488 - protein, 91 aa, Artificial Sequence
  Optimized for E.coli
MGRVDAGDVATSAGVSASLYSTFKDDKMVIPARDDASSFVASGGAIRGVYLESVLQKIRQENPGLNASDEELARAILTQQAQPAGHHHHHH

SEQ ID NO: 4489 - protein, 640 aa, Artificial Sequence
  Optimized for E.coli
MGHHHHHHWSDLTVFGDSLSDGGNVGRFTYDGATHPLYDEIVAQSLGDNLRPSSQGGSNYAEGGAVAVPAINPLFNTQDQLDNYLAARGGRADPDGLYIHWIGGNDLAAAALAPLAARQIVDNSASAAASQVSRLLDAGAGTVIVPTVPNVGATPALLQAILQVLGPAAQPATAALFQSLSTTTTPDRAAREQAIETALGEAAGQISSIPLIRDAIAQQLIAAWQLLSQEAAALTDRYNQAEEQGLMAARGNIARVDINGLFNEVIDNPGLYGLTNTAGMACPPGVSAMDCTSSTTGFSQSQQYLFADRLHPSPAVHALIADYIQSVLNAPLQVAALSRAPSMLVGDAHNTLDGHLQQQRQQPANAGEFTVFGGYAGQQRDFRGDSLQDGDATSASGTVGVGYQLTDHWQAGAMLSTTSQRQDPSSRFDYRLRGNLVALWSQFNYLDRGWINADAHYADLDFDDIERQIRLGPATRTEKGNSDGKVLGMRLQTGWDLPLGSYVSTGPVASYALDYTQVDGYKEEGNSSTSMRFGDQTLHSQIGSVGWRIDSKDLLINPWAQVSYNHQFGDSDSAVTAGLKSTRTAFTRSSDASDDNWIDMAVGASVPLGTSVNAFAGVSAITGNSDMHQVTWNVGLNARF

SEQ ID NO: 4490 - protein, 750 aa, Artificial Sequence
  Optimized for E.coli
MAPAAADSATSPARPRIGLVLSGGGARGYAHLGVLQALEKMHIPIDYVAATSMGAVVGGLYASGLSVDELDRILTGTNLSDIAFDRNERADLPQSQREDDYQYPIGLSAGYGDGKLKLPAGLVQGNNLLALLQNWTPQLPANISFDKLPTPFRAVATDLGSGAEVVLSQGSLPRAIRASMAVPGLFAPLKLDGRTLVDGGLVRNLPVSLARSMGADIIIAVNIATDLQDPSTLESPTAVAQQMVTILIQQNVKHEIDTLKQQDVLIEPNLGDLSFADFSRGKDGVKAGYDAAERQSAKLAALALPPQQWKEYLAARSGGGPVLAQDTHIDAIEIRSNGQVPAAVVRRALDVKEGDFYNPVALNKDVARLATNGDFKSVTQELVTENGRNVLKVDADDKSWGPHFLLFGLGVSNNFDGRGDFNLQIGHRLPWLTESGLEWRNDAVLGSKQASLHTELRQPIWNTVGLYVAPYAEYGRRHIDLYTDEGAVTSKTVPVTAYRVDTTRVGVDLGIPIGRLGEFRAGVNYQWLTAAPAYNLPTEFANLIGVDTIFDKFRINQPVVRAQLTIDQLDDPLFPRKGYYLSAVSNIGLGGAANSYSDAQGKALWAGSRGRNTVNLALEAAGTYGNETNDASGNGGLGFSLGGFQHLSAYAPDQFNGNYLLYGRLTYLRDMPELNLPGLRNTVLGTSLEMGDIWQTREAFGTGSYKKSASVFLGGSSFLGPLYFGAAIAPRGVWNLYLQLGRVFHHHHHH

SEQ ID NO: 4491 - protein, 943 aa, Artificial Sequence
  Optimized for E.coli
MGFSALTLGVAAPAAAAVPPCPGTGGAMQIVAHTDDDLIFISPDFMRDIQSKRCVQTVYATAGEAGEGAAYWNSLEAGIRASYAKMAGVADAWTTSDAGVPGRPLTLQTLNAAPNVSVVFMRLPDGFPDGRGSSRYNGQSILKLWDGRLSSIRPVDGAAAFTKAQFQTTLNQLVANYQPTTFRTQDWTGNYQDPYDHSDHWATAKFAQLASRAYTGPHTASAYDAYVIDEYAQNVTGADLTNKVNTFVRFADFDKYLCDTPCPAPPYSDWLKRQYITAIEWTGNAAKSAGTTVSASSQKASGQSPEKARDGYAWGTPMDANREWVTNGGKAGSWIQYNFSPARTINAVTLFDRPILSDQVTGGNLAFPDGSTVPVGALPNNGSGLTVNFPARTVSSVRFNITSVSGSTTNIGLSEFEAHITADVVAPEVTATPPGGTYDIGQKVTLSANEPATIFYTLDGTTPTTASAKYATPITVNGPLTLKYFAVDAANNPSAVVTQSYSTGPDVTKPVVTANPLGGAYAPGTSITLTSNEANSVIKYTKDSSDPLTAGLVYSTPIVFAGPDPMTLKFFATDPAGNVSDVVTQTYNVPPDTRAPVVTANPTSRALASGATITLSADEPGASIYYTTDGSSPTATESATNFKYSAPLVMGTSQLTLKYIGVDAAGNTSPIGTQTYSVPAAGPPSSHDFNGDGKADVLSSDTAGNLYLYPGNGGGGLGPRQTALAAPAWSTITDTITPGDFNRDGKPDLLARAGDVLWFYPGDGAGSFGARVQVSTGWSTMSQLFSPGDFSGDGIPDLIARRSTGDLRLYEGNGSGGLRTPITIGTGWNVMNAILSTGDFNGDGTGDVLARRSDTGALWLYPGDGTRGWLAWKQISTGWDNRTSIAGPRDLDGDNKNDVIGRIGDTLWLYPGSGNGTLSNVPPTSLGTGWQAMKIIGHHHHHH

SEQ ID NO: 4492 - protein, 80 aa, Artificial Sequence
  Optimized for E.coli
MAEDAPSADPEVTIRTEGDKTIQEYRQNGFLYAIKVTPKVGKPYFLVRADGSDGNFIRSDQPDMLIPAWKIFEWHHHHHH

SEQ ID NO: 4493 - protein, 327 aa, Artificial Sequence
  Optimized for E.coli
MAPMWPVPQPYPVPDDPTESLADLPPGSEYVALGDSYSAGYGLGDRTRLPTSACVQSARDYPHRLAARFGLDLTDVTCAGATSEDVTTGHQFTGVPPQIESLSSRTRLVTLTIGGNDADLFGTAASCLAISADGPVFSGRDAPSCESTLVQDGEDQLSVKIQSRVALGIADTLAAVQRAAPNAVVVFLGYPAIFPDAEHTPAKGCFRSALDLGTLAGSFPSDTFPFTDDDVAYLHGVQEELDAVSASAADAAGVRFVDVLERTEAHSACAPADERYVAGVSLTGSSDLRRIDLKAGALHPNGRGVAYLTDQMADAIRELAGHHHHHH

SEQ ID NO: 4494 - protein, 884 aa, Artificial Sequence
  Optimized for E.coli
MGQTSGPQPAPTSEAPGGGSSQGPQPAGNGPASPPVESTPRQGKLPDQQAPITGVELTPGVASQPAPDPAGKAEAQATKPKSMPGDAPDAESMKAAMRAAIPAGGAEMGQRSPRVVTNKQDKEAAAPARGKAVGAAVKATVPMAADTGHWRPTIGIQGQDVSAHQGNVDWQSQWSQGSRWAYVKASEGNYYLNENYTQQYNGSRNVGMVRGAYHFAIPNWSSGADQARYFVANGGGWSADGYTLPPVLDIEYNPYAGRTINGFYFGNTCYDMSKAQLGQWAADFGNTVKALTGRFPVIYSTTDWWNTCVGNSTFGSYPLWIASYWNNPTNSPGSLPASWNDYSMWQYSSTGPFEGDSNIFNGTFDELRTFARGVPTPSNPSIRSGADVLAVMPSGRLDNFPADGQGRISGPVTIGSGWGNALSVHVVDWNQDGVQDILAQWADGTLQVFRGTSGGGFSTPIQVGSGWQEMSLATGWWNSKDAFPGVIGQDGSGNLYRYQNASGGALGGGVLIGTGFSGHQFNLLDFDGDGSQDLVSRTGDGTMRLFRSNGLGSFLTEPARVIGNGWSAMTSVSSAAGFNGSGSQGLQARAANGDLYYYPAVNGSWGNRFLTGLGWNDALLIGGAPVNVEATLGVDEPDVLAIRQDGNLYRYAGSGSGGLTSPELIGKQWTGLKAGFLTDWNGDGALDILAQWSDGRLTLYPGFKGAGFGSPISLGTGWQDWTLTVGTWKKSDPRPSIVGYDPAGRLFQIGNPSGGALGTRTQIGTGWSGLDIVQMDFDKDSNADLLAKTASGDLMLYRSTGTGSFIPEAPAAIGTGWNVINSFGAIRGFAGAGSTGIIGRTTGGELRYYPVGQNRAWGPTSVIGSGWTGLKILSPASRHHHHHH

SEQ ID NO: 4495 - protein, 95 aa, Artificial Sequence
  Optimized for E.coli
MGIDQVACGNRTDFAKLDIRVGQNLGTNRCFANSGVVAVEVPNVYRASSGNNKLTVNYQSGSQYYTRTLTPGTHINFASVVRVYEVRIWHHHHHH

SEQ ID NO: 4496 - protein, 122 aa, Artificial Sequence
  Optimized for E.coli
MGQSGLPDVKQQGDVSYVSGGVGLDESNAFQRAEHQWPLSIRFTGAGGEYLSGVHVSIMSHDGEVLKADTRGPYMLVRLAPGAYKVSANYNGKTEMRNVTVPAKGDAKLAFSWAAQHHHHHH

SEQ ID NO: 4497 - protein, 86 aa, Artificial Sequence
  Optimized for E.coli
MGSGFLSWEGPQNTGRAKELTRCGCSNIDPNFRAAYRFTYTGQTAAMYNQPDCAGTSHYTFRGNSESVQPFGWRSIFIHCHHHHHH

SEQ ID NO: 4498 - protein, 197 aa, Artificial Sequence
  Optimized for E.coli
MASLHTAKEGDTFFLLAQRYGVSVDELTKANPNIASNNIYAGLQIKVPGEKSVKAASDSKPQLLTEKAPANEGPTIEAWGKTFNYSKIVDVKASAYSAAADENGKWGAVDYYGNPLKLGTIAVDPNVIPMGTKVLVTGYSHPGLPDHSFVAVARDQGSAITGKRIDIFIPGNKSFVNDFGFQNVKLYVIDKHHHHHH

SEQ ID NO: 4499 - protein, 222 aa, Artificial Sequence
  Optimized for E.coli
MGLATEPDLRVVTWDRGPDPAADAQVSTGESCAVEAQPLLPGQDPGALPPAPEVCFGSLEEALEFVSGGDVASSRLADVTAAEVEGLVSDLNASASSAAAGQRLAGTERATTAAASSLVLGVLWRDANYKGTSKVLYGSGTNGCYTGSTYGFPNLANLLMNNVVTSATTYAGCWVTLYDSYGYAGAKKNCTPHCATLGTFDNKASSVVYRPVGQLGHHHHHH

SEQ ID NO: 4500 - protein, 598 aa, Artificial Sequence
  Optimized for E.coli
MASTRQMEKLNRGAVAVKVPEGVLVSWRLLGTEADSVGFNLYRGTSKVNDAPITSRTNFLDKAGTTSSSYTVRAVVNGAEQAASPAVKVWNNNYLDVPIQQPAGGTTPDNVNYTYHANDASVGDLDGDGEYEIVLKWDPSNAKDNSQSGYTGNVFLDGYELDGTRKWRIDLGRNIRAGAHYTQFLVYDFDGDGKAEIVCKTADGTVDGAGVKIGDASADHRNTSGYILKGPEFLTVFSGDTGKALSTIDYVPPRGTVSNWGDNYGNRVDRFLAGVAYLDGVRPSIVMARGYYTRTVLVAYDWRNGNLSRRWTFDSNSSTNAGTAGQGNHSLSVADVDGDDKDEIVYGSLVVDDNGAKLANTGMGHGDALHVGDLDPDRSGYEVFKVNEDKNATYGAAMYDPRNGNILWGVNTGKDTGRGMSADIDPRTKGNEQWAPGIGLRSAKGQLITNTLPSSINFGIWWDGDLLRELLDHTSSSAGKIDKWNYMNSTTSNLLTATGTSSNNGTKGTPSLQADLFGDWREEVIWRKSDNSALRIYTTPYESEHRFYTLMHDPVYRLSVAWQNVAYNQPPHTGFYLGEGMSKPQQPNIYTPHHHHHH

SEQ ID NO: 4501 - protein, 331 aa, Artificial Sequence
  Optimized for E.coli
MGCDEEGVNVSLLDQADREIQAKFPKMHSFLLLRHGKLIWERYYNGHEVSSLNDLRSATKSFTSTLIGIAMARGDMPGPETAVHKLLPEYLPRRKETLLEQITIRHLLTMTSGLYWQTGKKLGEAFIHRFHRSKSWPSFALRLPVQEDQLGVFQYRSVDSHLLSVLLTHCCGIDAYTYALQYLFEPLGFGRSGWAQDPEGYTMGHIGLYLTSRDMAKFGDCCLHQGSWNGTELIPADWLHQATQRQVEGYPEFGDYGFQWWTGRLHGINYACAHGHGGQQIYLVPEANAVAVFTADSKVSRWKNPRTLLERYVLPAVSSLNLERSHHHHHH

SEQ ID NO: 4502 - protein, 42 aa, Artificial Sequence
  Optimized for E.coli
MGGIPGQPDPDTPQPAEPTEPGEPTLPDEPPPAPVAHHHHHH

SEQ ID NO: 4503 - protein, 92 aa, Artificial Sequence
  Optimized for E.coli
MGIDHIPCRDGENFLKIWSHLGGSSSVDCYANKGRISFGGWWIDRIYTGNNDLIYYDSNGSDVRINRWTDISFPNRPPKVRVIEILHHHHHH

SEQ ID NO: 4504 - protein, 118 aa, Artificial Sequence
  Optimized for E.coli
MAIGHYELKKAKNGQYHFNLKASNGEIILGSEMYASKASAENGIASVQTNSPQEAQYELKHSTSNQPYFVLKAKNHQVIGVSEMYSSETAAKNGIQSVIKNGPSTDVRDLSAHHHHHH

SEQ ID NO: 4505 - protein, 332 aa, Artificial Sequence
  Optimized for E.coli
MGQAPISSVGGNGSANSGGGLISQPPPIVSGSGRAAPAASGGRSENVVTQNGRIIYNRSYGNIPKGSYSGETYTVKRGDTLFYIAWITGNDFRDLAERNNVSAPYSLNVGQQLQVSNGSGGTLTGGNAITAADATAGGVPTQPTTAQMKSTTVARQPVITYSEDSGKPSEGKMLPSAGTNTVATTTAPVSAPTVSSTTNSSTPVGSWRWPTDGKIIDNFSASEGGNKGIDIAGSRGQPVVSTASGRVVYAGNALRGYGNLIIIKHNDDYLSAYAHNDTMLVREQQEVKAGQKIATMGSTGTSSVRLHFEIRYKGKSVNPLRYLPQRHHHHHH

SEQ ID NO: 4506 - protein, 321 aa, Artificial Sequence
  Optimized for E.coli
MGSCLDGNRMTGVNLSGAEFAADKLPGTIFKDYVYPDPADMRHFQSLGMNTFRLPFLWERIQPQLLGPLDEAEVHRIEETVAAARSLGTCVILDVHNYGEYRGKPIGSTEVPRAALADLWTRLLARFKDPENTAFGLMNEPSKLPVAEWAAVAQETLNILRKKGSRHLILVPGGSWSGAHSWFAKDNGVSNADAFRRFHDPADNYMIEVHQYADADFSGTSNTCVDPARLGAIMADIAVWANSTRRRLFLGEFGVPANQQCLQALAAIMDGMKGNSAWGGWTYWTSGKWLGNYPFSLQPDSNGDKPQMTILKTGMHHHHHH

SEQ ID NO: 4507 - protein, 167 aa, Artificial Sequence
  Optimized for E.coli
MGTYKLVNSGPEYAQVLAVQPVKQQIKTPREVCKDVTVTRQAPVKDQHQIAGTVVGALAGGLLGNQIGGGTGKKIATVAGAVGGGYAGNKVQEGMQERDTYTTTQTRCNTVNDISEKVVGYDVKYELNGKQGQVRMDRDPGSQIPVNKEGQLILGQNQPAQHHHHHH

SEQ ID NO: 4508 - protein, 240 aa, Artificial Sequence
  Optimized for E.coli
MAALVGGCTMTPWTDSWQPTSTPQPSRQNQGGVLAGYYRVNPGDTLPSIAAGFGQRSQDVASWNHIAPTDMLTPGQVLRVAPPPGNTAITSPVPSSGQPSSSALPGATAAEPPALAWPAQGTVTSRFIPGKTRGITITSTGDKTVRAAAAGRVVYAGTGVAKYGPLVILKHESGLITAYGHNGKLLVNDGDAVAAGQAIAEMATDPDGRSSFDFEVRQDGKPVDPIGFLPRNGGHHHHHH

SEQ ID NO: 4509 - protein, 129 aa, Artificial Sequence
  Optimized for E.coli
MDNKAYVSQTYPRLTVYNEENFRGSRRVFRGNLGIRNTDNILDGIESLRFFSTSSNATLVLFTGTRFRGNFRVFRGNRNIADLDDLIRGNDVESIISTNQRLTLQQIRNIRSSGRLPSGYRIIHHHHHH

SEQ ID NO: 4510 - protein, 631 aa, Artificial Sequence
  Optimized for E.coli
MGNSMQWSSIRDGSLYLRTAQPDRLKIGWSPAWQSDANREQLYLLQPDGQLFKQLEIRADQAYGEQDIELPAAAGDYRLQIPGYSFRGFTVSHRGSTAAQFEPTKVHFSAEVHSGAELYFRVAAGEQAILAGKYYGGVSVLQASRLSDGAKVRLELKEHPAYGQFDQVALPPAEQDEVWRLSLGGSGKAAFWLDGTANLFAQEVQQLHSLDQPRGEAHLQLKAQILGTTPRLGIALPYAQPPQSTFGLLQAIGARAANFYSFVDVIEQEPEREIGFRRLYRERFGIDRDITLLAGTGRRAVLAADAQSFAGLDAWLADSVRLAGNGLHYLAFADEPNLNYPDYSSYALYFEQMLARAKANPEARAAGVRIAMPASSRLLDGPFRIGAGQRRGIDWARQLLERHGEDIDALAWHEWMVRDLLATRRYRDSVRAAAELVGLDAAGRPRKALLLSQTNISSGRDLSPYQQDTHYAGLWWASVVINASADGLLDMLNWFQAADEPDYPKGMLAQRSASQFSLKPVAVAQQFIARHWLAHVQALDNPAFEVDALAMSEAGRHSLLGVNKASRVQAVSLDGPGDLCQAAPLKLSLLGPDDQPRDATVECRDGRVHFELPGETLFALTWKALHHHHHH

SEQ ID NO: 4511 - protein, 134 aa, Artificial Sequence
  Optimized for E.coli
MGQTDSALPPVQKSGAVEYLSGGIGLDESTAIQSASPHWPLSLVFSVQAAGKAEFASDVKLEIRDAKGGVALETTASGPFLLAKLPPGSYSLHATLAGKALERKVQVKAGSSARVELVWPAGTNQGRPHHHHHH

SEQ ID NO: 4512 - protein, 531 aa, Artificial Sequence
  Optimized for E.coli
MANLSDIQVSNGNDRASITLSFGGQPVYGFFPLHNPERVVLDIRQSGVIKGLPLTFSGDNMVKRIRASTPKDKQSIRLVFELTQPGKTRAVTQRNGSTYNVVFTINGTRPAPRSAAVSSVSRPVPADNPFKGNAVTAVSNGNEVAVPGRTVRAVDEAIIVAIDAGHGGQDPGAIGANGLKEKNVTIAIARKLKALLNADPMFKGVMTRDGDYFISVMGRSDVARKQNANLLVSVHADAAPNRSASGASVWVLSNRRANSEMAGWLEQHEKQSELLGGAGDLLANSQADPYLSQAVLDLQFGHSQRVGYDVAVKVIAQLQRVGSLHKRRPEHASLGVLRSPDIPSLLVETGFISNPSEERLLGSSAYQQKIAESIYKGLRNYFLAHPLQSIPKEENRPLQSATAVDVQPNPAPVSTRYAGAVTRHVVKRGETLSGIADHYGVSMAMLRSMNTLKKDVVWVGQRLKVPASGAQSVSASRPQRHKVVRGDSLTAIAAHYGVSPKAIQQANNMKSQNVMLGQTLTIPTSHHHHHH

SEQ ID NO: 4513 - protein, 1077 aa, Artificial Sequence
  Optimized for E.coli
MGQEMQEVAPSVSTSDSEVGTSESRSDVSGEMTETTTNASSEQASQGEETMMNSELVSASTDMSLFFDKKIRLRSVRSESAYLTWDGNGQFLMDALQSTMNQSFLINGTVEDGYTIQNSETSANLHVLSKEAFAQREEKIEQKWFFELLENGSYTVQTADGLYLSSNDKNELILSADAEDEAARWQVEVIEEPQKLPMEAPLTKIPLSEISIANGTYQIQSSGLSMFLSIGELDKTLRKQLVVSSEGYSLSSKFQITRQTDGWYTIKNKYSLLAADIAGGIGKPQVAVQQYQDNQSAAQRFRFLDAGNGDVVIESKLGTVIERTGGQSNESTPVQTYTFNNSAAQKWRVVSETVANEVNIADGIYNIAGSGINKNLSLANKSKSDRIGIVLDRNVSDQVQQQFDIKKEADGWYTITNNFSKKVLDISGGSAGSRVAVQQYFANKSDSQKFKFIDGGAGNVFILSKLGTVLDRTGGKTDNGTAIQTYRLNKTISQLWRLSAPQSPKTVDIKDGEYQIKGNSTTRVFSIGDLTTADAVLLRLRDSTYSKIDNFVINKQVDGWYQIKNKFSNKVLDIQSGSSKNGVQVQQYFANNSEAQKFRFIDAGNGEVYIQSMLGSVLERPGGGTSEGLAIKTNDLTNSAAQKWKIEKQASPNLVKPVNGQRYLLEAGNNTNAVLDINGGSTANGAVAHIWTEAVAPQQKFIPRDLGNGWYRLENEKSKKVLDVAGGSSSAKVAVQQYAWNGSDAQQFRFVDAGGGYVYVQSKLGSYLDMVGGASSNGTRIQTYSLNKSAAQKFKLQNISKANALRTTVTTNNQAKITVYNPNGGKVDSVRFPTWSREKGQDDIKWLIGKKNIDGSWTAEVNAAEFKNGGTFDTHVYVKSGGKESGVGTTSYKLDKPAPPAPPKPTAPPYYYSQWDGRWSGLTYGYYRFGPTGCVPTSMAMVLRGSYGVNVTPVDTANRIRSYGGFNVQYMGASSTDLVRGMNSYGRSVYAAKSEADLTDHLVQGYPVIMYVNVGIGHAIVAHGYSNGKTYISDPYNNQFYSGWVSISHLWSVPTKDPQDWNYGYPYFIIKHHHHHH

SEQ ID NO: 4514 - protein, 350 aa, Artificial Sequence
  Optimized for E.coli
MGLAACATQEPTTSGTQNAASTGKPILAPKPAAPAVTPQQAELKSLVALQDRLYDVAAPLLVNNAVLCRNNARNLLGFTAKTKFSYTAEFIDAATSLGLTDQLQVTGVLTGSGAAKVGLQRGDLLVAIQDKPVPTGADAERQTALMLGPLVNGRSNIKVTIARNGSNQTLNVPLTRACAFGIELGNTDNVISYADGRRVLISAGMMKFVRSDDELAYVIAKEMAHNTLTHPARQRLTATLSGVIDNLVRLRPDNAPLSGAAGVKPYPQQLDAAADKLALYMVARAGYKVDDASAFWQRLATQYPATVLNGYTAIHPATTYRIAAIEQAVSDIQAKQASGSTVLPHHHHHH

SEQ ID NO: 4515 - protein, 733 aa, Artificial Sequence
  Optimized for E.coli
MAIVLENPLWHIVLDPGTLAIRVTPAGAAAVQVSDGVGSHRVAALQSTADQAGWQWDDGAYRIEAKLSERDLMLTVRANAAGALTLIRQPGSAIGRGLILPLAEGHYVARDNKVWNDFILQKMGRLNTTQDLSLPLWGMDHGKFSLHWLLTNPYNNQLDFSADGSGLALQASHTFTQLAPDTPMTLTLHLGDGDLLAGAKHYRAWLLAEGRFESLAEKTAKSPGAAKLIGASHAYLWGSGLIAAKDVRSWPAFLRILRSKNPLAIDLRRHFAPESRKALAEAGTNPARYQEKILVGAFNAGLNSLAREAWQTDAPDVNRLASRYGELRSEVARAFGAALNADAKDWGGGVSGATMEQLRKAGLARLWLGLGEGWEGGLWHPEAIAAGVKAGYLLAPYDSYETALPRGHNPDWATAHFGEKTYRDCAIVLDDGRFKTGFNGFGHYTNPFCMRPLMEARVRAVQEKAGFNSWFLDVTAAGMLFDDYRRRAAMTMAQNAYANAASTRWISEDRQLPAGSEDGNAVTAQGIFFAHGMQTPVIGWGDKEMQKDKKSPYYLGNYYPPEEPSNMFKAVPLKALYRSIHFDPAARLPLYQAVFHDSVITTHHWLFDNLKLTNVRRENELAQLLYNVPPLFHLSEGTLASRLPLMQRQDAFFRPLHEKLANQALTGFRWLSADRLLQQTGFADGTMQVANFSAEERSFNGRRFPPYSVTALTADGKTTVFVSEDGRHHHHHH

SEQ ID NO: 4516 - protein, 401 aa, Artificial Sequence
  Optimized for E.coli
MGRAGILCREFAIGFGPKIFSFKKNETVYTIRLLPVGGFVRMAGEDPEMIEVKPGYTVGLLFNKEDEVEKVIINQKEKYPDALIIEVETADLEHEMKITGYEQGKEDELAGFTVSQTSFFIVDGEEVQIAPYNRQFGSKPVWKRIKAIAAGPIMNFILAYVILVMLGFIQGVPSNQPELGKLTDNGRAAAAGLKEGDYIQSINGEKMRSWTDIVTAVKENPGKKIDVAVKRDGKSFHISVTPEAVKDENKKTIGRFGSYAPTEKGALAAIAYGATSTVDVTKAILTNLSKLVTGQFKLDMLSGPVGIYDMTDQVAKTGIINLFQFAAFLSINLGIVNLLPIPALDGGRLLFLFIEAIRGKPINRDKEAFVVFIGVAFLMLLMLVVTWNDIQRLFLHHHHHH

SEQ ID NO: 4517 - protein, 392 aa, Artificial Sequence
  Optimized for E.coli
MGNKDVLVDLDIPQAGNYAQLYMPQATSNPIGMGISITDQDYQVPYAAHLGGSLAAQTDISVTFKVSPELVTQYNQKNNTTYQLLPEGSYALQTENAMIPKGAQGTGILKLVIKTKGFLQAFESYLLPVSVSAPSGVTLNKELSTTYFVITGSYAPGEVPREKVLSMGADAGDFLIDFNGDFIRKAPLTGDLILYKADAATGQFTAPPKTIGFGWNVMDKILSYGGNRLIARFGSGAGDINQYFLSQDGAFGAQRGVGQGWGGLSAIVPFKGLLLGIAANGDMTKFPLNGDGDFDYGNIKQIGTGWAGLAQIFSYQNSLITIENSGDMWQYPLTDDGVFGARKKIGTGWDMYTKVITAGTDLLALDANGDLWRYKFNPDGLWPLKKHHHHHH

SEQ ID NO: 4518 - protein, 110 aa, Artificial Sequence
  Optimized for E.coli
MGRDMLGLSMDMGGKKSGNLVQKARTKMMDAAFPGMGEITLNKEDTHKDQDHHSPTDKTAHNAHTAKNKEENMKLIKDFIRTSPDVKREVEQILKETHTAVPGLHHHHHH

SEQ ID NO: 4519 - protein, 642 aa, Artificial Sequence
  Optimized for E.coli
MGHHHHHHYDQVYVFGDSLSDTGNNGRFTYDGNKHLLYDEVLAERIGAALVASDDGGYNYAAGGGVAVPALNPADNTQDQVQSYLGRVDGRADGDGLYIHWIGGNDLAAAALNPTTASDVAYNSAAAAAVQVRSLLNAGAGTVIVPTVPNIGSTPQLMELIIQQALTPVQGAAVQAAYATLNSLTTPDNVSRTQAIHQALTSAAAQASAIPQVQQAIAAQLIAAFDSLSAQAAQLTDFYNQSEDRLLAQGGGNVVRVDVNKLFAEAIANPAQFGFANTAGMACPAGVSSAVCSSATPGFDASQSYLFSDHFHPSPQAHLLIADYIQALLDGPAQVVALNQATAAMARDSRATLDSRFQQLRNGDNPQGSLGVFGGYAGQHYDYSANKAAGDGNATTHNLTVGVDYQLAEGWLIGALISGSNDDQQPSSRYEYKARGLLLSAFTALDLFEHGWVNADLHYATMDYDDIRRSMQLGPLTRTETGSTSGKQWGARLTAGYDFPITSYLTTGPMAQFAWDYSNVSGYSEDGNNSTSMRFNDQTYHSQIGALGWRLDSQFGLFNPYAEVSYQHQFGDDVYRAGGGLKSTQTSFTRDSAGQDKNWVDVTLGANMPLTDQVAAFAAVSQTGGLSSGEQFMYNVGVSARF

SEQ ID NO: 4520 - protein, 158 aa, Artificial Sequence
  Optimized for E.coli
MAEPTLYGRYEYIALPEVGGQVLKAKMDTGALTASLSAKDIETFTRDGEEWVRFRLATKNASNKVYEHKIARISKIKTRSEEDEEDSEVIAPTKRPVVDLELCLGNVKRTVEVNLTDRSSFNYPLLIGAKALREFGAAVNPARRFTADKPDCHHHHHH

SEQ ID NO: 4521 - protein, 165 aa, Artificial Sequence
  Optimized for E.coli
MADSAKASYKAAEDAADATYKADKAKCDELSGNGKDVCLKQAKATREHTKQDAKAEYKNTPKAVAGARKSEADADYAVAKEKCDALAGNAKDVCVKQAKADQTNAVANANTQKDVSKAKADAREERADARYKVAMAKCDALAGAAKDDCVAAAKADAGKHHHHHH

SEQ ID NO: 4522 - protein, 608 aa, Artificial Sequence
  Optimized for E.coli
MAIFDYKGQDGRVLISDAWNLATYTSGVATVGALYNLPGAVLGEGNTFVLPKGWREISASDLGIDGSHLDLTGSFKGENVSGSQAKVFGQYDESGKLVKMGFSIAGTNSPMDLLGYPAMIDNSYIHGYDYLLDSIKNYATNHNLTGKDVLVTGYSQGGSVTNSMYLGRDTLADGFFKDSDYFGMASPKASNSDGIFNFGFENDIVHRLIGEQTDLSGAILAALKGSDANYTSTTDNIVLFDTVYALPTWPNGPFSVVNPNGWVAHLEGIFINPIQRIGQSTFYDYIERDSTIIISNLDPVSRSFTWVSDKYSATSNHFGTPAFLLGTDSADKLQDGRNDDFLDGFAGNDSFKVSTGTDIVAGGVGDDKVFLQGTVSSYEAVRLSDGSLFLNDTGGRYGLKELHDVEHVEFEGLLGQALTPAYTVTSSKLNFEGLFGSDKSYAKATEGTQLADLLKGTAGRDLIFGQGGDDLIEGGAGHDLLHGGSGNDTLLGGNGNDALYGGAHNDILVGGLGNDTLSGGVGSDLFVFDQGGFGHDLISDFNVHQNGFDQLVFSKSLFASAAAVISATSQQGSDSLIVAGDSSITLVGFNAAQLSADMISLVHHHHHH

SEQ ID NO: 4523 - protein, 391 aa, Artificial Sequence
  Optimized for E.coli
MEPHPQVQNDAQQYQGDALKLLERLVNIDSGSGYEAGLNQVSDIAIAELKKLGASIEKVPNGAAGGNHVLATLKGTGKARILLMAHMDTVFKEGTAAERPFRIQDGRAYGPGVMDDKGGIVAGIYALKVLDNLKFKDYAQITFLLDASEETGSEIATDLIKKTAKAHDVTLNLEPGRPADGLVVWRKGSATALVEVKGKAAHAGVAPELGRNAAMEAAHQILQLGKLGDEAKKTTINFTVLKAGDRTNVIPDQATAKADVRAAVPEEFDRIEKDLARVSANKLIADTEVKTTLQRGLPPMPQTEQSDALVAMAQGIYGELGRKLTIEGSGGAADSSLSAGVGTPTLDGFGIVGGNIHTPEEYAEVESVAPRIYLLARMIMELSAKHHHHHH

SEQ ID NO: 4524 - protein, 478 aa, Artificial Sequence
  Optimized for E.coli
MVQNLPTLGDTSRESLSPLMERKLGEEVMHDIRRDPDYLNDAPLLEYLNNFGWTLVNARPEVRGEAGFDFFFFAVRDPVLNAFALPGGFIGVHSGLLLAAQSESELASVLAHEIGHVAQRHIARMVGSQKQDSMIALASMLLGALAMRGSGDAGAAVMMGGTGLAMQRQLNFSRDAEREADRIGLSILDSGGFDTSGMVAFFGRMQTASRNYSDVVPPYLLTHPLTTERIADIEARIREQRYRQRADSLDFQLIRARVRVLQDDTEQGRRDAQIVFDAQLQLNTKQQIVAAKYGMAFLAFKQGAYDKAEDLLQQAVAAALPAKQSLVLTDLGVEIMLASKREAEALKLVQQGQLQYPLSRGLAHQYARALIASKRLDDAIKYLREQARLYRQDADVQDLLAQAYSAQGKRALQHMALAESYVLTGSVPAALDQLRIARNSGDAGFYDQSMIDARERELQERWKEELAASKERHHHHHH

SEQ ID NO: 4525 - protein, 480 aa, Artificial Sequence
  Optimized for E.coli
MASIGERLTSPEAGWKRFDDKDPNIIYKGAWRDGNGDIYYNLSRKVTNRSGDTATLSFFGDKIRIITDSATGHSNKLNIEIDDVLESFPLNKGAGSQYLTYEKINLDNTWHKVVITTTDSLFSTIDAIDISENGFLGNPTVIEKIKVTSGEASADLNWGQVELATSYKIKRSTTSKGPYTTISNNSTGLEFNDSNLANDTTYYYIVEAYDKSGKLIHTTKECSVTPPYSSMEGMGGISPPVGTTATASSDDKNAIKALDRDFDSRWNAVTPIASLELKFPKPLHLNFVQLAAQVTPQTQVDYTIFGLKDGEWTQISPITTRAIDVSTQMRVLDRINITEGVYSSIKITANARSSWASIHEITLGIVSAIPVTPDSPGSETPTPDQTPNPEPSQPTGDRAILSVTLDTGLEKEFDLSMKEVNSFIAWYEGKQSGSGAASYAINKHNNNKGPFSNRKDYVIFNKILTFEVSEYSTKHHHHHH

SEQ ID NO: 4526 - protein, 233 aa, Artificial Sequence
  Optimized for E.coli
MASTSGSHKSNQRGTATVPAPVEKDTSVQAIEEAAWKKHKLPKTLEEAMQMNRASVLLLSVPESDTEYRLDNDKPSITTEDQAEQDSLLDCSITSIHIAEGRPRPKQRVVLSEQDIDQAFDTAKELNLNVIHDGSATSDEASDDHIASPQYGSIPFHLPAQADRGEVSVVFEKPFIDTQYVITANASILGVMVSVTQRQRYSAVLTVERIHSGPLCEGLVLWIAMGQHHHHHH

SEQ ID NO: 4527 - protein, 375 aa, Artificial Sequence
  Optimized for E.coli
MDANDNAFILDKRGVLKERSFRDSSRAGSIWMPPFFVQEIMQSSSNLFPVALISAERRGDLSEDVYRLKPGNSPDFTVELAVTRLGMADESSSRGVPVILLHGSFSNRRFWFSPKGLGLGAYLARQGFDVWIPEMRGHGLSQRNHDYRKNRVADYARYDLPAIGAFVREQSGQVPHWIGHSLGGTTLAAALGGEYIGEPVVASAAFFGTQVSRTYWPLKIPPVEWSGRFILKRFAQLSGSRLKRGPEDEPIGLALESMRWFGLFGRFGDADKDWWAGLAEVKLPVLAVSAAGDHQDPAWACRKLFEQFGSEHKQFINLGREQGFGDNFGHVEMLVSKAAQAEVWPLVTRWLADQQTPLPGAQQDLVVAVHHHHHH

SEQ ID NO: 4528 - protein, 295 aa, Artificial Sequence
  Optimized for E.coli
MGRISLFSGTPTVIGHDNRGLTVRDILYNRHPGLPEATDERITRHRYDARGFLTQSADPRLHERGLANFSSVTDAAGRVLRARGADNGTIVMLNDAAGRAFMTVSNIRTTEDDTEDLSQAVTRNWQYEGAILPGRPVSMMEQVTGKTARITARFVYAGNAGEEKALNLAGSCVSHYDTAGLVQTDSIALTGVPLSVICRLPKDADNPDVMTDWQGDDASLWNDLLDSESQATLTTADATGAVLTTTDARGNLQRVAYDVAGLLSGSWLTVKGGREQVIVASLTYSAAGQHHHHHH

SEQ ID NO: 4529 - protein, 439 aa, Artificial Sequence
  Optimized for E.coli
MVDMRKGALISGDSASYSDLNRLNQLKVGDKNSEGNLRKVAQEFESLFLGEMLKSMRSATEALGKDNPMNTPEAKQYQEMYDQQLAVSMSREGGGIGLADVLLRQMSKNKPLASGEAATLSAAKQQEALDKAKAPVPTPVAAGTLPDGPLSRSNGQRPLWASRAVSAPQGAEGIHRNDMELINQRRLALPPKLADRLLAGLVPSASVKPEAVAQNVLPDRAVAAVKPATGELANGDWLAALKAAEPKGDMQVYGRAVAQPPLAPARKAFRDADEFVNAMLPMAKEAADRIGVDPRYLVAQAALETGWGKSVMRQPDGSSSHNLFGIKASKNWTGDSARAITSEFRNGEMVKETAEFRSYASYRDSFHDLVNLLQSNSRYQDVLKSADNPEQFVRELQKAGYATDPNYANKISNIARQMTSYQNYASAGATTTLHHHHHH

SEQ ID NO: 4530 - protein, 236 aa, Artificial Sequence
  Optimized for E.coli
MGNTDTLLQSGAQAYQAATLSDSDVKALSDKSCAEMDSKEQIAPASSDYTKRLNKIAAALGDNINGTPANYKVYVTKDVNAWAMANGCIRVYSGLMDMMDDNEVEGVLGHEMGHVALGHTRKAMQVAYGTVALRTAASSAGGVAASLSQSQLADLGEKLVNAQFSQKQESEADDYSFDLLKKRGINPEGLATSFDKLAKLDGGHESSMFDSHPTSEARAKHIRDRIAAGKHHHHHH

SEQ ID NO: 4531 - protein, 317 aa, Artificial Sequence
  Optimized for E.coli
MGSEEKETAYIDVAAATLWTAPNILREVDAPSATNPVDMKKWTTSMDLKQKQQLSSDGMLETQALYGNKVTVLERQGDWVKVAVDGQPTSRNELGYPGWMPNKQLTYSKRYDQYAKDPFVMVTAPTTYLYHSPYLKKKGIEVSYNTRLPLLTKSKRAYKVLKPNGKTAWISAKAGKIYASQKDIPVPTGTELVESGKAFLNLPYLWAGMSGFGFDCSGFTFTMYQSHGITIPRDSGPQSRAGKPVDMNNLQPGDLLFFAYNQGKGSVHHVAMYAGDGMMIHSPNSERTVEIIPLNTKGYIEEYAGARRYLPHHHHHH

SEQ ID NO: 4532 - protein, 599 aa, Artificial Sequence
  Optimized for E.coli
MDTVAANTSTPLAATPPMGFNNWARFQCTAQAPTDGSARANYSFQHFMLDQAEAMRATGLVASGYTLLWVDDCWMSRIGSGQIQGAARWGGSQQPGFDPDLGAYVSAVHAKGMLAALYNTSGAKTCQGVAAGEQGHQLQDAQTYVAWGVDALKLDNCGAIDNATPQQLFKQMADALGQASAGSARKILFNESAPAGYGPTGSAKYATLDWVRPLGQMWRTGPDIRTTSMTAGGQAASDPWDYYNANAYQEGVYQSYNETIALSRYVSPGNWNDPDQLLIGDNGLTPAEERSQMALWSAMAAPLILSTDVRKFAANPADPRWQQSLATLNNAEVVAVDQDRLGIGGYRVSRDDPSSSAGIEVVAKPLADHALAVVVLNKGAASASPTLSFSNLGYRNGADGTPCTLAVRDLWAHSGSQLAAQVPLTIGAHDNAMLKLSGTCGGWAPTGEIETVGDWGATPLCIAAGSAAPGAALALANCDAGPKQRWSRKADRTVELAGTGLCLSSTAPGATLGGAAGQWATLASCNAQDTKQQFSYRRNGQLAAAADGTCLDIYRGVVDGTLGKPGTPLDLYACTANQVNQIWAAPHADVLNDHHHHHH

SEQ ID NO: 4533 - protein, 369 aa, Artificial Sequence
  Optimized for E.coli
MGQTLPPPTVAAKSWLLLDTTSNQVVASQDPDMRIEPASLAKIMTAYVVFDALKDKKITLDQMVNVSVRAWKVDPSSSKMFIEPNTPVSINDLLYGLMVVSGNDAAVALAEAVAGTEDSFVALMNHEAERMGMKSTHFGNPHGLPSADTYSTARDLATLAAHVIVDFPEFYKIDSTKKYTYNKITQPNRNRLLWLDPTVDGMKTGHTSSAGYSIIASAKRPNAGGDRRLLAVVIGTNSDGTRTQEAQKLLNWGFQNFDAVKLYAKGQAIDTPQVWKGAKSQIKIGFTHDVYVTVPKGIADKIKPVLERTDPLIAPIQQNAKVGTVKVNADGKTIAEFPVVALEDVAQATIFGRAWDSIRLLFKHHHHHH

SEQ ID NO: 4534 - protein, 362 aa, Artificial Sequence
  Optimized for E.coli
MAINVSAKSAIVIDGTSGRVLFAKGEHEKRRIASITKIMTAVLAIESGKMEETVTVSANAVRTEGSAIYLTEGQKVKLKDLVYGLMLRSGNDAAVAIAEYVGGSLDGFVYMMNQKAEQIGMENTRFQNPHGLDDHENHYSTAYDMAVLTKYAMKLKDYQTISGTKIYKAETMESVWKNKNKLLTMLYPYSTGGKTGYTKLAKRTLVSTASKDGVNLIAVTINDPDDWDDHMNMFNYVFDHYQTYLIAKKGDIPKLKGTFYESKAFIKRDITYLLTEEEKEDVKINTTLLKPKKAWEKDVSKIPDIVGHMKVMFNDETIAKVPIYYENERNQKPKKKFFETFQSIFLNAAGGAKWSIHHHHHH

SEQ ID NO: 4535 - protein, 454 aa, Artificial Sequence
  Optimized for E.coli
MVELPDFTQLVEQASPAVVNISTTQKLPDRKVNQQMPDLEGLPPMLREFFERGMPPQSRSPRDRQREATSLGSGFIISSDGYILTNNHVIADADEILVRLADRSEMKAKLVGTDPRSDVALLKIEGKDLPVLKLGKSQDLKAGQWVVAIGSPFGFDHTVTQGIVSAVGRSLPNENYVPFIQTDVPINPGNSGGPLFNLNGEVVGINSQIYTRSGGFMGVSFAIPIDVAMDVSNQLKSGGKVSRGWLGVVIQEVSKDLAESFGLEKPAGALVAQIQDDGPAAKGGLQVGDVILSMNGQPIVMSADLPHLVGALKAGAKADLEVIRDGKRKNVELTVGAIPEEGKEMGAEPKSSVERSSNRLGVSVVELTDEQKKTYDLKGGVVIKEVQDGPAALIGLQPGDVITHLNNQAIGSTKEFADIAKALPKNRSVSMRVLRQGRASFITFKLAEHHHHHH

SEQ ID NO: 4536 - protein, 474 aa, Artificial Sequence
  Optimized for E.coli
MGHGYVESPKSRAFMCSATGGNLNRDCGPVTYEPQSVEYSPSVQHHYPKDYCSGDFTKCGPANGTIPAGGITSFSQLNEQTATRWQKTTIKPGMNEFTWHYSAGHASAYYQFYITKKDWNPNQPLTRDSFEMTPLLNENAGGVRPPAGGKTKHKVNIPADRSGYHVILATWKIADTAATFYQAIDVNIDNDGAPIPDWKTLGAVQPEQLRVGDKVSTRVFTNAGEQQNRQTRLSIETAEQAQANTWPFLLAQQVNKANAGYVMGELNANNEVVPNYGKNTIYAKNNSDVVRVEIQKEQPSIPGELKLSGLQAEYSLKDSATDLHFNAIAQGGKYTIASTVFNGKGESIAHQQAEAGNNTPHFSIPLRNVSEGEYDVVVVAKPEKGEQLQQSQRITLKAEEVGGGGDYDFVFPKGLTGYKAGTKVLAKDGNVYECKPFPYSGYCIQWNAGATQFEPGVGSNWKDAWIRKHHHHHH

SEQ ID NO: 4537 - protein, 519 aa, Artificial Sequence
  Optimized for E.coli
MDQSIKYDHTYQTPSYIIEKSQPSWQPAQNLTQKEALFSYLDKQQTHFKLKGNANSHFRISKTIKDSKTKQTFFKLEEVYKGIPVYGFGQAVAMKENKQVKSFFGKVHPQINDISVTPSVSKKKAIHTARRALEASIGKIEYVDGEPKAELYIYPHEGAYDLAYLVRLSTSEPEPGYWHYFINAKSGKVIDSFNAIHEAAGTGIGVSGEEKSFEVTEQNGRYYLADETRGKGINTFDAKNLNETLFTLLSQLIGYTGSEVVSGTSVFHDPAAVDAHANAQTVYDYYSRTFGRHSFDQNGARITSTVHVGTQWNNAAWNGVQMVYGDGDGARFKPLSGSLDIVAHEMTHAVTQYSAGLLYQGEPGALNESVSDIMAAMTDRDDWEIGEDVYTPDVRGDALRSLEDPSKQGNPDHYSNRYTGTEDYGGVHINSSIHNKAAYLLAEGGVHHDVRVEGIGREACEQIYYRALTYYVTPSSDFSMMKQAAIEAANDLYGEDSKQSASVEKAYDAVGIQHHHHHH

SEQ ID NO: 4538 - protein, 359 aa, Artificial Sequence
  Optimized for E.coli
MGQSYVYKNLSLPDVDGVARAINNQGQIVGSSYFEGAGNHATLWSGSTTTDLGSLGPSSSAARAINGSGQTVGYSLYSSTSITATSWNAASGSPLALSPGTQSNARAINNAGQIAGYTTAAPGSSRATIWNGNSTTYLPTLGGNDYALGINNHGVVVGDAYFTGSEASHAMVWDGGGVRGLDALGGVGSSAAAVNDNGAIVGSSQLANGTWQATLWNGDTISNLGAPGYDGGQAWAINNRNQVVGYTYTGNNNDSSTWRATLWDGGRMVDLTSFVDSDSRAAGWVLTQAYGINDKGWIVGEATNMQTFSRHAFLLSVSAVPEPSAYASLLMGLACMGVLYGRRVGSTKKNPPAHHHHHH

SEQ ID NO: 4539 - protein, 370 aa, Artificial Sequence
  Optimized for E.coli
MEPAAASAVWVGSAPAGTKILPGDQVTSPNGQFKLIMQGDGNLVEYGIGNRVLWASNTAGNSGAIAVVGKNRALDITKNGKRVARWASAGTVNSTALKVRADGTMALLAGKTVVVSWNGYQDRVPSGNTILGGTVLRSDTSNTRILNMRTDGNLVQKVSGRVVWQSRTGGHPGAWAELQAKGNFVIWTRDASRKKVALWSSRTSTAGSGNLLVQVDGNVVLYGAKDTRVWSSRPVTGLAWPVNGTKITGRYGDDRGAGHVPRYHQGTDAPVPVGTAVYGSGTGTVTKTIANDAAYGNYIVVTYGMTAVLVAHLSKIEVKQGQIVKLGTEIAKSGNTGQSTGPHVHVETRRNGTLVDPLKNMHFRHHHHHH

SEQ ID NO: 4540 - protein, 465 aa, Artificial Sequence
  Optimized for E.coli
MATIKVKSGDSLWKLAQNYNTSVAAITSANHLSTTVLSIGQTLTIPGSNSGTSSSSSGSTAKKSGNSVYTVKSGDSLWLIANEFKMSVQELKKLNGLSSDMIRAGQKLKVSGKVSSNSSSGTSSSSKSSKSSKSSSSSSASTGTYKVQLGDSLWKIANKVNMSIAELKVLNNLKSDTIYVNQVLKTKSAGSNSSSKNNSSKSNQSASATTKYTVKSGDSLWKIANKYNLTVQQIRNSNNLKSDVLYVGQVLKLTGKSSSSTSTTPSSSNSSSGTTTTTYTVKSGDSLWVIAQKFNVTAQQIREKNNLKNDVLQIGQKLTITGKASSSNSSSGSSGSTISTSAKINKMIAAAKDHLGVPYRWGGTTPAGFDCSGFIYYALNKVTSVSRLTAAGYWNTMKPVSQPAVGDFVFFSTYKAGPSHVGIYLGNGEFINANDSGVVISNMNNSYWKQRYLGAKRYFHHHHHH

SEQ ID NO: 4541 - protein, 994 aa, Artificial Sequence
  Optimized for E.coli
MDQQRQVVGTGLTKPAGTVVDPVGKVWVSDSVAGFCRMSDPVNGQPGTVEKDTCLGGSLAGSQQGPKVPGVATILDPTPSSAGSGDETAFIPDSSVGSSHVVRAVWSPALDLFEYSSTLTILDGDVRPNAVSDGPDGNIYLSFANARSIIKIVDPTIKHPSIESIASVTTKALGLVAAGWDSNGHVSVYVLETTGMRAFSAPDDGDMTNYVPLASYNVGVASSIFYDYDAHIIYTGTSSGATAADAGKDKVSRLNLSTGTVDNSWALGFSKISGLGMRAGQLLVLDDAGQLNNPPATGQGKMSLLGGVVAQITSGPTLANGSQSPNPAFTNDTTPTFGVSADPSGSALECSVGGAWTDCTSGTYTSAVLANGPQTFSVRPAPGGVPVSRTFTVDTVAPAAPVFTAPNSGQVVNGKPVLGATFEPGTTLSCSVDSTADADFKACVPGDTFTLTTEGAHTLRIRSTDPAGNVGPAAALTVTVDLTAPQVAITAPASGATVGAGYQFQFASTSPDIAGFRCRLGTDAFTECTSPKVYADIANGPNRFEVEARDKAGNTTVAGVNFTVFVADTTPPTVTADPVAGTYGPSSKIALTASEADAKIYYTEDGSTPTTASTLYTAPIAMGSKTLKYIAVDAANNASAPQTQVYVLDNVAPAVTANPTGGNLALGQSVTLTTESGAKIYYTTDNTTPTVASQVATTTVTITPAATTTVKYFAVDAAGNQSAVASQTYTLPAAPANTWKDYNSDAKNDVLARDSAGTLWLYPGNGTGGWLGKVNTGTAWNNYNLIVPTRDFSGDGRSDVLARDGAGQLWLFKGNGTGGWQPAVSVGSGWSGMTAIVAPGDFNGDGKSDVLARDAAGVLWLYKGDGLGKFTAGSTQVGAGWNVMNTLFSTGDFNGDAKTDVIARDTSGGLWLYPGNGTGGWGTRTQIGSGWGGMTALLGPGDFNGNGKSDVLARDASGNLWIYPGNGTGGWLAWSQVGNGWQGFTSLPHHHHHH

SEQ ID NO: 4542 - protein, 73 aa, Artificial Sequence
  Optimized for E.coli
MDRPGAGWVTIEKAIETAKTKAGYIEIYKIEADNNGYWEGEGRKSDGVVYEFRIDGASGNVVRDQKDHHHHHH

SEQ ID NO: 4543 - protein, 64 aa, Artificial Sequence
  Optimized for E.coli
MENSQNNMGTNDNGRTQMLTTNNNDDDNDNDNWGWLGLLGLVGLAGLKRREPENHKKRHHHHHH

SEQ ID NO: 4544 - protein, 56 aa, Artificial Sequence
  Optimized for E.coli
MGSNADCAQQIRSHSSEAASGYIYVNRLDAPQKSPVNAPARAAEKSSAHWHHHHHH

SEQ ID NO: 4545 - protein, 101 aa, Artificial Sequence
  Optimized for E.coli
MAKKALPVTLHVENADGSPAAGVTVTVMKAAESDHQPNIDRGEIIGKTDHHGEMTWKSGAKGTYAVVFEKDGVPETRNISLAESDKHTVISITLKHHHHHH

SEQ ID NO: 4546 - protein, 252 aa, Artificial Sequence
  Optimized for E.coli
MGSKSIAVSQQSQQLHNDVQEAVKSIMGATQLKASDYGRVLRSALAASQKTVTIEIAAGDLTLLKKSNYKLCFAKKVGDADYNVVWQSYDAYLSNNEFSWTPQYQLFASNLFKANVQVKVSTNIVNIGLGQTSTLDEHGLLSSAVTGGPNISMTFVNDYAPIHPGINQLSTGIDGNQVSTPIYVAVDQVVTGETVLTPVETILVWFEQNVQTSTMFSTSRSKAIEIDLTFDNTAGRLYEGGQWKTVHHHHHH

SEQ ID NO: 4547 - protein, 353 aa, Artificial Sequence
  Optimized for E.coli
MEWPAWQQYKQFYISDEGRVIDPSSPNRITTSEGQSYGLFFALVANDRPTFDKLLEWTENNLAAGDLSAHLPAWLWGEDDKKRWTVLDTNTASDADLWIAYNLLEAGRLWKSRRYQTLGTLLLQRIGREEVADIPGLGLMLLPGKIGFVAQDRWRLNPSYLPPQLLARFAALNGPWRAMQKTNQRLLLETAPHGFSPDWVVWQAGKGWQPDTVKPDVGSYDAIRVYLWVGMLADDDEHKAALVKQLLPMAQLTAQQGVPPEKTDTASGKTSGDGPVGFSAVMLPMLANQTAALDVQRQRINQHPPGDDAYFSASLTLFGQGWDQQRYRFNRQGELQPAWGGQCVTSKHHHHHH

SEQ ID NO: 4548 - protein, 195 aa, Artificial Sequence
  Optimized for E.coli
MGTPTALADKFASTVTDDGWTLDLAATKLSANPVPNLATTAFTREGFVSAKVTGTIGGQGDSAVKTGYVEQGLQIGCQIDVSSGLGLGLGFSLGPSVGVSISGVPSANVGVNASVNPSIQSTIAPGTITTIPLGKKDLESSKASITAENVHVKVDACMGPVTIRSYAQLSVSTATSDNTLFVYSDPTWLHHHHHH

SEQ ID NO: 4549 - protein, 73 aa, Artificial Sequence
  Optimized for E.coli
MASLVSSEQAQGLQPMNQTISIGGRNGDQTHIRQVLSEKADAQGASHYRIIENNQDNTWHVTAELYKHHHHHH

SEQ ID NO: 4550 - protein, 115 aa, Artificial Sequence
  Optimized for E.coli
MADGYDRCPDGYYCMFSGLDGTGDMIALREDTPDLAALGMNDRAKSDWNRTASTIYLWSDAQYTGCTAVTSAGPTGKGNFFPTYQDFFSSVQFDGPGGPSCGTPPGEGRHHHHHH

SEQ ID NO: 4551 - protein, 86 aa, Artificial Sequence
  Optimized for E.coli
MGSVYVAYEGPGFSGRSVALSACGINNIPFGGSYKRYGTGQSGRMYNLPNAQGVAHFTLDSNRNAEQITPVGWKSVFIVCHHHHHH

SEQ ID NO: 4552 - protein, 818 aa, Artificial Sequence
  Optimized for E.coli
MGNQNYKNNEYEILDNGNAGYQPRYPLTKAPYSELRNMNYKDWMNRCPNRIAVVPAEGYDVNIRDAVITSINILTSLLSLAIPVAGVAGGIISAIFGWLWPTNTEEVWQAFMSAVEDLVDQKIDDFAREQAIARLRGMHGVLELYETAVSNLQKDPQNERLKENVRDQFVATNTFVVGSLPLFRVRGYEVPMLVAYAEAANLHLLLLRDAVKFGTSWGMDAATVNGYQRNLETGITVYTDSCVETYNKGIEKTKTLKANVKDYDRYPWAQYHDLLPSLGGSPEKDFQNIENWNLLNSFQRDMTLMALDLVSIWPTYNSKEYPLPVKAQLTREIYTDLRGCYAGDINSTEAQIVRPPHLFTFFQSATLYTGNNPFTPYVGIQQSGHYTLGPSFTTAVNGISEGAPNTVTANPSDAIINKVDIDTGNELYRFMFYQENYTQPFKTVGENSSLGYVRTINRIPIEGDQTLANHRMSWISGSLRPASTGPMGTQIPPYISCAALGWTHISANRDNRIVSDRITQIPAVKAYWNRGAFSVVRGPGSTGGDLVRLSSSGEVSIKVRPSRTGIFNYRVRIRYAAVASGKLNVKKYVNHIHASTTYDYKQTTAGNLTYSSFQYLEVYNFTLAESQFEVWLTNETGGPIYIDKIEFIPLTPKPEPKPIVPDGTYQIVTALNNSSVVDLDQSPTPPNWASPRNVQLWGNGNATNQKWKFVYDESKYAYQIINLANPKEVLTWSFNVERLSEVNAVPNQQDNRQYWIPEHAGNGYFYLKNMEDANEAYGALDVSNASTANGTKIIYNGFNGGTSQKFKLNRLSHHHHHH

SEQ ID NO: 4553 - protein, 302 aa, Artificial Sequence
  Optimized for E.coli
MGSSTDVQERLRDLARENEAGTLNEAWNTNFKPSDEQQFSYSPTEGIVFLTPPKNVIGERRISQYKVNNAWATLEGSPTEVSGTPLYAGKNVLDNSKGTSDQELLTPEFNYTYTESTSNTTTHGLKLGVKTTATMKFPIAQGSMEASTEYNFQDSSTDTTTKTVSYKSPSQKIKVPAGKTFRVLAYLNTGSISGEANLYANVGGIAWGVLPGYPNGGGVNIGAVLTKCQQKGWGDFRNFQPSGRDVIVKGQGTFKSNYGTDFILKIEDITDSKLRNNNGSGTVVQEIKVPLIRTEIHHHHHH

SEQ ID NO: 4554 - protein, 667 aa, Artificial Sequence
  Optimized for E.coli
MGTELTPGIAAPLGAHYDGNGINFTLFSAHATGVELCLFDGQQREVRLPLPARSGDIWHGYLPGGKPGQRYGYRVYGPFDPAQGLRFNPNKLLLDPAARAVEGPVADDLELHGGYDRPDPQDSAEVMPKCVVIDEAYDWQDDRPPATPWGKTVIYEAHVRGLTLLHPDIPPVLRGSFAALGHPVMIAHFKRLGITALELLPVQQHSSEPRLQRLGLINYWGYNVLAPYAPDNRYCSLRTDMTPLREFRDAVKALHKAGIEVILDVVFNHSAELDMDGPTLSLRGIDNPEYYWLTPDGEYVNDTGCGNTLRLDKPQGVAWVMECLRFWVSECHVDGFRFDLGSVLGRTPAFDRDAPLFQAMLADDLLSRCKLIAEPWDIGPGGYQVGAFPGRFAEWNDHYRDDMRRFWLQGDLPLGQFAQRFAGSSDLFNQRGRAPYAGINMLTAHDGFTLQDLVSFNRKHNQLNGEGNRDGSDHNFSYNHGVEGPIADDAIVQRRRASRQALLATLLLSQGTPMLLAGDEHGHSQQGNNNAYCQDNAITWLDWAKADDSLTAYTAALIHLRRQIPALQQDRWWQEGDGSVQWLNAQGLPPAAQEWEQGDLQLQIRLSQRWLVVVNATPQPVEMRLPAGDWQVVAPFTQEGSRAVLPAWNQAAHSICVLVQKHHHHHH

SEQ ID NO: 4555 - protein, 463 aa, Artificial Sequence
  Optimized for E.coli
MDDLPSLGDASSAIVSPQQEYQLGRAWLAMLRSQVQQLSDPQLKDYVESSVYKLVETSQVSDRRLEFILINSPELNAFAAPGGIVGVNGGLFLNAQTEGEYASVLAHELAHLSQRHFARGVEASQRMQVPMMAALLAGIVIAAAGAGDAGIATIAGTQAAAIQEQRRFSRQNEQEADRIGIINLEKAGYDPRSMPNMFERLMRQYRYDAKPPEFLLTHPVTESRIADTRNRAEQAKQGGIEDSMRYQLIRARVQLIYEETPGLGAKRFRAQLDENPKNDVARYGLAIAQIKGGQLNEARENLKLLLTTAPNEIIYNLAQVDLDITNNRLPDAQTRVDRLLTQFPGNYPLNQVRVDLLLKQNRTADAEKALENLLKSRPDDPDVWYMVAETRGLSGNIIGLHQARAEYFALVGDYRQAIQQLDFAKRKAGGNFPLSSRIDARQRELMEQERMIKDMMGHHHHHH

SEQ ID NO: 4556 - protein, 335 aa, Artificial Sequence
  Optimized for E.coli
MGTTADPAPAPATLSVASADKLAGTLLSELGDEAAGTYYDAKERKLVVNVVDEDAAEGVRERGAVARVVEHSLAELKSARATLKAEATIPGTSWSVDPVTNKVVVTADSTVKGAKLEKLNKVVDGLDGRAAVERVAGEFKPFAAGGDAIHSGGGRCSLGFNVVKGGEPYFITAGHCGEQGSSWSDSAGGAAIGTMEESSFPGNDYALVKYASGADHPSVVNLYNGSTQEITQAGDATVGQQVQRSGSTTQVHDGEVTGLNETVNYQEGSVSGLIKTTVCAEPGDSGGSLFAGSTALGLTSGGSGDCSSGGTTFFQPVPEALSAFGASIGHHHHHH

SEQ ID NO: 4557 - protein, 668 aa, Artificial Sequence
  Optimized for E.coli
MGMQTPAPNQLCIADRNAGLRRLLSVPFKRNKQMKSEISAKALAANFAIPQASALSLALSLVFASLSVHAAVADNSAWVTTKTQAFLPQVQANQKSVAADASVVTPAATAVQLAQGEPVHVTLSLNLRNEAKLDKFLQDLHTPGTASYGKFLTPAQFAAEYAPTEKDVAKVVAHLSKSGFVNIQVAPNRHLVTADGTAATVQTGFRTALKRFQQDGRKVFANTDAAQVPAALSGIVDSVLGLQNVAIAQTHHRWVQTPEAGVSAQAKVTVNATPVATAHSPVQFPAIYSVGTTPTASNTVVGIISAGDLSPTITDLKTFTTAKGLATVNTLVVKTGAAGADYSDTSGQVEWNLDSQTITGTSGGVKQLIFYASPDMSFSGITAAYNRAVTDNVAKVINVSLGGCESDTHSDGTQAADDNVFKQAVAQGQTFSISTGDAGTYNCQTSSISGAPGVPKNKSTYDVSEPAASPYVIAVGGTTLYTNSGAYSSETVWNEGLSAIGTYDDAGDYDSTKRLWATGGGYSKYEAAPSYQSGVIAAGKTTRGLPDIAFDAASASGATIYYNSQTGTVGGTSLAAPIFAGVWARLQSANNNALGFPAASFYKYFPVAANASLLHDVTSGTNGASSSYGYKAAAGWDATTGFGSLNIGNLNTFVKNTSDFARHHHHHH

SEQ ID NO: 4558 - protein, 365 aa, Artificial Sequence
  Optimized for E.coli
MANEVFANNMEISCKAADGKSVAAFPDVCFTPPQAPPTPTGVPIPYPNTGMAKDTTRGSRTVKITRKEVMLKNKSYFKTSYGDEAGCAPKKGVITSKIKGKVYFTSWSMDVKFEGENVVRNLDMTTHNHASQPGNSPTWPYIDTAAAANSSHPCHNVVKGLKDNNCQRHVDANTYSTDAINRAGASEALCGDPKCKKAMECVLTPYEPSNCCDGKTPHHIVPKSQFKERGKGGKALLLDAQGANKYDPNKAPCICEDGHSHSTGTHGDIHEETNLLTVNHPTVKPKVTGKTIAPDARWSVAEAEAVGAEAAQKGGSKCDKECTKSQVRESHQKMNIGPTDQIRPSTAGRVPEPSNPTTFHHHHHH

SEQ ID NO: 4559 - protein, 92 aa, Artificial Sequence
  Optimized for E.coli
MGIDHVTCDPDRGYLKIWSHLNGRDSVDCYANRGKTNFGNWWVDKISTGNNVVKYYDANGDVVKIDRNKAISYPNRPPKVKAIEILHHHHHH

SEQ ID NO: 4560 - protein, 124 aa, Artificial Sequence
  Optimized for E.coli
MATHAAKALQIASSKKGSPYRYGATGPRSFDCSGLTLYSYKKAGKKLPRTAAQQHNRTKRIAASNRRKGDLVFFHSGGSVYHVGIYAGGGKIWHSPKSGAVVRLEKIWTGSVRYGRVNHHHHHH

SEQ ID NO: 4561 - protein, 63 aa, Artificial Sequence
  Optimized for E.coli
MATVDTSATYVLVNRNSGKALDVYNFSTADGARITQWTRSDANNQQWQFVDSGGGYYHHHHHH

SEQ ID NO: 4562 - protein, 390 aa, Artificial Sequence
  Optimized for E.coli
MASTCDRYASYPVKGGTYTVITNFWNDKASGSQCVNVNQDNGEWSVSSAPSSPDSTPAAYPAIYKGCHWASCTKDSGLPLQAKAITYAPTRWRVTPGAGGDWDIAYDIWFSSGREAPPSGQPDGAEIMIWINHSGSVQPAGSKTANVNINGMNWDVWTAWNNPSGWPRWNIVSYVATSPVNAVNFDLVPFFRDSVGRKAVDNNWYLLDVEAGTELWRNGAGFASGDFDVQFHTDPVKGIDPNKWYSVVNKNSGSCVDDADFSTSNGAVVHQWACDSRGAANQQWKFTPTDSGNYRVSTQQAPGLAWDVAGWGTANGSLVQLWTYGGGSNQQWQAVDLGDGYYKFVGRGSGKCLDVPAASTSNGVQLQVYDCNGTPAQSFKLIAQHHHHHH

SEQ ID NO: 4563 - protein, 117 aa, Artificial Sequence
  Optimized for E.coli
MEDTCAKQPSDGALFQCTVQQKKLAEDELNKEYQTAKKRIVQMYGTQKKLADDYVATLVDTQRSWLRYRDGQCKLEAFAAEEGSNANAVATNLCVIRIDKERTAILKQLPYHHHHHH

SEQ ID NO: 4564 - protein, 126 aa, Artificial Sequence
  Optimized for E.coli
MEEESRQRSKRPYPVQVEPEVRERIDSTREMPHKDIDVEEHHAEEQHKVPDIQTDKKVEKDRENIKDAYGDQDYRAALRGFARKDEEKDRRSQISNGEKETHKSEDEQYREALRSMNQKKHHHHHH

SEQ ID NO: 4565 - protein, 120 aa, Artificial Sequence
  Optimized for E.coli
MGFYNPYDYNPHYDDPYHYVEVQHRVNRFFEHIDGKGASFTLNSGERLSYVGDAWNDRISSVRVAPKTLVVLYEHINFTGRKKLLENSSNRSHLFNIHEDFNDITSSIKTFRLCHHHHHH

SEQ ID NO: 4566 - protein, 61 aa, Artificial Sequence
  Optimized for E.coli
MADQSNQYRAHYVQHQAPQWAVMSSTSENPGMAQVADAPEAVVLPANPRPESWVFHHHHHH

SEQ ID NO: 4567 - protein, 236 aa, Artificial Sequence
  Optimized for E.coli
MAENIEAKAIGPKHGATLIPKARQVICEQDGGYNHPDDGSNIPNAACRNAFLYKAETIPIWERRQMFTEWPAYSQNLQGTQHPSDKVPDGQLCSAGIAKFEGIDQPHADWYVSSVSVKDGQATLYFDATQVHEPSKWTVSLAKPSFNAATDKLKWSDLTPLEVTKVTVPPPAKGNHVKYAGVYQIEVKIPADRADGKQTLLYVQWERQDPARETFFSCSDVRFNGESAAKHHHHHH

SEQ ID NO: 4568 - protein, 256 aa, Artificial Sequence
  Optimized for E.coli
MGQITFYENDGWRGRTFTANQQVRDFTRNGFNDRASSVVVDRGQWEVCDDANFRGNCMVLRRGSYESLRGMGMNDRISSVRPVGKRNSYANEAPAPLPQPTYEYRRRPSERLVEVPVTSVRAVVGTPEQRCWVESQQVAEPARNGTNVGGVIAGALIGGILGHQVGGGTGRDVATAGGAVAGAAIGNNMANNSGQQSYARDVRRCENVSNPKPEYWDVTYNYRGQEHRVQMSTPPGQSIAVNSNTGEPRMHHHHHH

SEQ ID NO: 4569 - protein, 832 aa, Artificial Sequence
  Optimized for E.coli
MAFIQRYSTTTNGAVTFTGNTLGLSNINISYTDIGAFITLDLSKQVPGYPAGTTLDWKENASAAQLRLPTGSIVLYAELIWGGSTKTSTEDVTSEIDRAITLISPKGSTLITPDPTTSQQVAQANQIFYVRSANVTSFIDAGGAGNYTVSGVPATVQRYKGNNVGGWTLSVVYKDPTLPLRNMNIHVGTASIEKTGSVSQKISGFSTPELGDVKARLLLTAMEGDSKIPGDQLLFGKDASSLKPISGPNNPIDNFFASQINDDAGNLDTSGTYGNVNVIPGSAGPAVRYNWDITNVDASTAMENSQTEALVQLTSKSDGYIVTGLGVQIDVNSPEIKINKEVDKEAAIVGEILTYTLLIENSGMTEAQKTILKDTLPPELKFVEDSLQIDGVPIPGGDPTKGVDIGSISIEGPTEVTFQTLVLKVPPDNRAVNKATVVYDFQSAPGLPVSSGTADSNEAITVIRKVEVEVVKRQDMSVYVKAGNIITYTIEVANTGDTQLTDVVIEDQIPNGTKLVTGSLQIDGRPFSGNIESGVNIGTVEPGTTTRVTFQVLIDNPVPKKVTNKAKVDYKYKLIPDGQIYRKVEMTNEVTAIHESNCKEAQKKIVTGIGEAELAAAGVIVAEKLKIQDAIRAFNEGKQSAEELLNENEQLTHKLTKTILDEKLQQDTLQKAKILCCDGIEGIDYSGVYIIKNKGSQKVLDISSASKDNGVNVQQWDYNGGDHQKWELEKMADGYYKIKAVHSGKLLTVSGASNSDGANVEQWEDIGGDHQKWKIEKNSDGTLKLIAKHSGQLLDLKSSIQNNGANIQQWPDNGTDAQCWELTKLKHHHHHH

SEQ ID NO: 4570 - protein, 446 aa, Artificial Sequence
  Optimized for E.coli
MATADDIRLNEVVTTGSTNDSIELHNKGAGTVDLSGWILKDSNSSSKYTIGSGTTLAPGGFRAFDVHDAFGLGSSDKARLYLADGSTLVDSFSWSSHSSASWSRCPDGSGSFGQAATLTLGAANNCGGGGGGGVTPSAWPGSSTVTTADASNVFGSDLSGLHQEGGVLWAAQNSGKLWRLVSNGSGGWQPDTASGWSAGKTLRFTGGSGAPDSEGVTVTGAGSGSAGGVFVASERNGDASGTSRLSVLRYDVTGTNSTLSATREWNLTSNLPSVGSNAGFEAITWIPDSALTSAGFKDESTGAAYDPSRYTAHTGGVFFVGVEGTGSLYGYVLTDTGAYTRVASLSSGMAGVMELQWEPQTSRLWLVCDDNCSGQHRTMKIDTTGAFATTAAYNRPGGMSNLNNEGFALAGECVAGAKSVVWSDDGNTGGHALRAGTIGCHHHHHH

SEQ ID NO: 4571 - protein, 550 aa, Artificial Sequence
  Optimized for E.coli
MGQSKTGNPQAENLRESLTRGVAKPAAGGEAAPSSTGAVSVTLANPAYRVKKTASTPEATARDFLATQARQLGLDATALAGLELVSQRQDPDFTVVRLRQVAAGLPVYGSEIAVTIGKDGSVLYVASNAIGGVAPKASKTQAVDQQQALDRARSYLGIGELRNAEAQLVAFRDAAGTHTAWKVRGRPDGGPKGDWELLIDATSGEVLRAEDKAFYATDGSGYVFRPDPLSSTKSSYGSTGYKDNNDADSAQLTAARVRVTLKDLKQSGASYSLSGPFASCIDFDAPRDNACPVQPSPAFEFTRGNLYFEAVNAYYHIDTFLRYVNQTLGIKALPYQYTGGVQYDPHGESGDDNSSYSSSSGRLTFGQGGVDDAEDADVVIHELGHGIHDWVTNGGLSQSEGLSEGVGDYLAAGYSRDFNQWSPSDAQYNWVYNWDGHNEFWPGRVTNYNVGRTYAQIRSSEIHTAGQYWASCNLVARDAIGGQAMDKAFLKGLSMTNGSTNQKAAAQAVITAASALGYSSTQINAIANAYNKSCTYAVTVPQKSHHHHHH

SEQ ID NO: 4572 - protein, 72 aa, Artificial Sequence
  Optimized for E.coli
MAQLVTGDQTQNLQPAGTVTISGTAGSPMDYRAELSQKADEQGASAYKVIEARTGDNYHITAQLYKHHHHHH

SEQ ID NO: 4573 - protein, 286 aa, Artificial Sequence
  Optimized for E.coli
MEVKLVVDFEAYENGQTMAKLLEELAAKPESAEVTDLIIGDWGGAYESSPDDFIPVLVKLKDHFPKLRKLFIGDMEYDECEVSWINQTNLSPLLEAFPALESFHIKGSQDLSLEPLRHNNLQELVIICGGLPVSVLQQIHNAELPELRKLELYLGVDNYGFDGNLKDVLPFLNSNPFPKLTYLGLKDSEIQDEIAIAAANAPVIGQLEVLDLSQGTLSDKGAEALLASESIKGLKHLDLSYHYMSSEMMQRWKSSGLSVNVEDQQEADEEDDWRYPSLTEHHHHHH

SEQ ID NO: 4574 - protein, 545 aa, Artificial Sequence
  Optimized for E.coli
MDMNPTEERLFLLLKSKPSFMRAMPAGREMRELVFKGRAVPGPLEWGESPTEIGIKPIGLVTHVARNCSNDTVGVISDTFKASYEQTQSWEVTVGTELTNSVEVTASLPGVVETTAGTAVTLKFEGSKGGETKSTKSHDAGYSIPVKPGRELDVQFQITEQVIEGTPFSIEMELLGKVEITHPPQGNWVRYRGSVPAKAVSAGKEWNAAGTKRRDLWVCRAAGSPHIGKVIGRRCNYGYGGQEKTTTNFDVLVVAGLETNWVGKSQFESGDDYDEDIVAEGKAEVFYGGQESRPTKRYKGWTFVCRAKHKGDFHPGKVVTNDCMIGYGGKELQKGRYEVLMRGKEVGDVTPVDLQDHLPDAAERTFVVEGVFEDARSFGATTVFGTSRPVNRTVCPGYVPPQNDTSIRDVEVRTSEPVTYSGDSVAIPAAYNDSREQPKEPKAQGEPAINGTVLAKISYGENGEARATLVSRILRDLRADMFGADVVAVQQALNDAGAALQVDGYFGAKTARALREFQRAQGLSVDGVFGPQSQNALGLHHHHHH

SEQ ID NO: 4575 - protein, 100 aa, Artificial Sequence
  Optimized for E.coli
MGDITLYTRAHFGGPALQLHGSEPDLDKLGFNDRTSSVIVQNGTWEVCENKHYKGKCLILEKGEYAELKNFNDMMSSVREIEARPAAKDKPEHKHHHHHH

SEQ ID NO: 4576 - protein, 502 aa, Artificial Sequence
  Optimized for E.coli
MGQLILKNTSLSPITCTVDGWTVSSGSSFDWFIKVQPGQSFFVGQNTSRPKDPVINWAKCNNLQTRAMTITPSGPNQTLVLNGQQTQVLNVSLYPFLPTLPTDNFENLVAYIVQTYQSQHPQVLLNAVLNPQVNIYSFTELPVLLGNDGFDVIELDVLYLGFLADNHLINPAQITGEAPWAVALAGATYQGQLWAIPSWLCMDFFYAFDQAIQQQKTLSKMLNYLNTRTSSVAKMAGSFNGSWAIPSDYINAYVQTYGYGALQQAMQMPPDNGVVHQLVSLSDTCSFNGVNKCTNNTYHNAPNGGAEQVFASGQASTDMGFSEQSFYVNLYSSAQKPLYVVPTPWGEHPQPLLFEDAFVSSAATCKPGSQCAANAQAFTTLMTGTAMKNYIVQSKDLPAGTPWRTLLVATQQFWQQSIIANNSYYQQLSPIFMTAKAFPNNFTPQSQVAMANGICNALKQQQPNFVCKSNNSTSLLAPSHGSSIINPGSTDSRRGLHHHHHH

SEQ ID NO: 4577 - protein, 691 aa, Artificial Sequence
  Optimized for E.coli
MESHVDNPYQGATKYISPDYAASVDTSIAKITDANLKAKMQTVKTFPTAVWLDRIAAINGGGGKLGLEAHLDQVLAQKKGSTPITAEFIVYDLPGRDCHALASNGELPLTQAGLETYKKDYIDKIAAIFANPKYKDIRIVAIIEPDSLPNLVTNLDDPKCAQAKSTGIYEAGVKYTMNKLNEIPNVYKYVDIGHSGWLGWDNNRSATVSLFTTIFKDTSKGLASVDGFITNTANTSPLTEPNLPDPNLNIGGQPIKSSKYYEWNPNFDESDFAEALHRDFVSAGWPSSLGMLIDTGRNGWGGPNRPTSAVGNDINSYVNSGRVDKRSHRGNWCNNSGAGMGTPPQTAPAGHIDAYVWAKPPGDSDGSSSLIPNDEGKGFDRMCDPTYTTKDGTLTDALPNAPISGAWFHDQFVMLVQNAYPAIVPSTGGVDPAPTAPAVPSGLKAVVGNAQVTLTWNASTGADSYTVKRATSEAGPFTAVAPLVTEREYTDKGLTNGTTYFYVVSATNAKGTSKDSAAVSAEPKGTPTDPTDPTDPTDPTEPAGDLVVMYRAGDTDPANNAVKPFFNLKNKGTTPVKLSELKIRYYFTKDGSQELQSAVDYAQVGNDNVLRTFTDNYIEIGFSPAAGTLAAGAQTGDIQIRMNNSDWSNLDESNDYSFDPTKTSYAEWNKATLFHNDKLVWGIEPHHHHHH

SEQ ID NO: 4578 - protein, 74 aa, Artificial Sequence
  Optimized for E.coli
MDKFTRRTTTLSDSDFSQAVSSETQAPIEGTEDLSCPWAPSVCNRHCLSHGYRGGYCAGPIKLVCHCYHHHHHH

SEQ ID NO: 4579 - protein, 406 aa, Artificial Sequence
  Optimized for E.coli
MGYIHIPKQIVLFEQQKEKINTTLPLSVEASSPVYDVTSNKAKLTVAGKQVGKEELMLHLAGIPVKRVDVQVLSDFKVIPGGQSIGVKLNSKGVLVVGYHQVDTAKGKKSPGEIAGIQVGDMITKINGKTIEKMSDITPFIQQAGKTGEPLNLHILREKKQFDTKLYPLKDKQDYAYRIGLYIRDSAAGIGTMTFYDPKSKKYGALGHVISDMDTKKPIVVEDGQIVRSTVTSIEKGSNGVPGEKLARFSEDRQIIGNITRNSPFGIFGKLSSTMENGIMDKAMPIALSHQVKEGPAKILTVVDDDQVEEFDIEIMSTIPQKFPATKGMVIKITDPKLLKKTGGIVQGMSGSPIIQNGKVVGAVTHVFVNDPTSGYGVHIEWMLNEAGIDIYKNNRKKASHHHHHH

SEQ ID NO: 4580 - protein, 225 aa, Artificial Sequence
  Optimized for E.coli
MGIDVTVWSVTLPVQTPAQVVATKAMPSLNNKYFDNNGQRIIFWAPVTGSHTGNSDYPRSELRETSRDGKHRNWRYNSGINTLKGELTVNQVPSEGRVVVAQIHAKNAPTPLLKLVYRFEKGTGNIDVEYRVKPKDKKSPVIYTVPKVPLNKSFSYTLQMDKQGQLSVLIGKNGKQVKLDKSWHGYDFYFKAGVYTLDNKGYSNEGGKVTYTKLSVSHKHHHHHH

SEQ ID NO: 4581 - protein, 273 aa, Artificial Sequence
  Optimized for E.coli
MVGSYIQNGRIDLMALLVFSLVVGFVGSFISLGMSRWMAKTMMGVRVLNPKKQSLSYEEQQLVDRVHRLSRAAGMTKMPEVGIYHSPEVNAFATGPSKRRSLVAVSSGLLQQMDDAAVEGVLAHEVAHITNGDMVTMTLLQGIVNTFVVFLSRIAAWVASRFVKEDLAPVVHFIAMIVFQIIFSILGSLVVFAYSRHREFHADRGGADLAGKDKMIHALRTLKSYSGHVNEEDQTAVQTLKINGKKHSSLFSTHPDLDERIRRLEAKHHHHHH

SEQ ID NO: 4582 - protein, 237 aa, Artificial Sequence
  Optimized for E.coli
MGKQIIAMGGGGFSMEPDHLVLDQFIINQSKQPSPRICFLPTASGDAENYVQRFYHAFQKLDCDPSHLSLFKPPTTDLASFIMEKDVIYVGGGNTRNLLVLWKEWGLDHILKKAWENGIILAGLSAGAICWFEEGVTDSAGPLTGLKSLGFLQGSFCPHYDGEKDRRPAYHHMISAKALSSGYAADDGAALHFIDDQFFQAVSSRSDANAYQVVLHENEISEIALPITYLSHHHHHH

SEQ ID NO: 4583 - protein, 742 aa, Artificial Sequence
  Optimized for E.coli
MACTYSMTYIQKVKAGGTYDIGTLVVTVDPVSAEASVGRYVVLSLPGSPSGYELFPGLSENEIAAKITGTNYFNTANGATFKVERLSAREVRLWVGSIATAGIAPGDDSRILIPLRITVPSGVSGDIILTVSAPSTSAFLNGSLVIARADANLPDWVFAVYMAADNDLSRFALADLREMLSVPGLGGNVVVVLLDLPGSENDGVYLVQRGTLQPVPGWPQGQELNTGDPSLLAAFLDFVRNKFPAGRYALILWDHGAGWRKLQPRGVCFDDLSRDFLMVPELRQALVRARVPLDLVGFDACFMGMVEVAYELEGLASVMVASEEGEPGDGWPYDKILTWLVANASTADGKALGRAIVSAYTQAYQGYGALTMSAIDLGCIKDVREKTDSLAVALLRNFDSDKTQISQAVQNARSYHREEFRDLYDYASLLTSYCSSSVEIRAAAQDLQKSIERAVLANGTTQYDDRSRGLSIWLPPESQAYLELLSYYGVDFASMFNWYSNLRFAKESRWGHFIKKWILDESTPIATAFGVESTDPADGATDVPVDKTITLTYNTPVRPGPAYGKIALLDASGRKVSIRKKLAGTVFTIDPVKNLSYGTTYTLVLPAGAVKDGAGNLSEEFVLSFTTEPPDVTPPAVVETDPPAGGVVDSLKPVLKVRFSEQVYTGRNYSRIAIYDESGRRVAVSKRISGDLLEVRPVGALKPGMAYRLYLPAGAVKDKAGNLSEEFELVFVAPGPHHHHHH

SEQ ID NO: 4584 - protein, 484 aa, Artificial Sequence
  Optimized for E.coli
MDGRTTHYRVIQLGAPKGAGGVQSNEVVSDFDSLVTHHPGNNRNAHLENGLVVGGERTRQHALIGGEIQEIEIVRNGNTFQGLKPDQVLLKKDFMLEAPGQANPRQVDVPSPVAGVVGRVSHAEGLVDIHDRQGGDVIARVRHMRDIELEVNDAVAYGQSLGTQHRVATEKVHVHMEVDTRYYRQFENYVGDLTEGRLPVEAAARLGVEPRAVADDGVLRLGESSLRIRDLQNHLNGMGYVGADGQALTADGVYRLNMQRAVLDYQREQCLPQTGDISREMLQAVPARTPGPFDPALGGIPAPGLPYAPMPHPFGTGADDRPCAPPTLQQIEDAAERRRPWDPAFSAAPPSISSDPLVQSIRERLPQAFATYGAAPPEVELDRIATGLAVECRKQGIERPDHIAVGNPATDGSGRHVFAVVGDLRDPASHRVDVAAHAAAQVPVEASLLKLDALQASTPALVQGDQAQELQKAPSMRVHHHHHH

SEQ ID NO: 4585 - protein, 194 aa, Artificial Sequence
  Optimized for E.coli
MGHGYVDAPKSRAFMCKAQENTACGAIQYEPQSVEGAKGFPDAGPADGAIAAGGLAQFAELNEQTPTRWKKVALTTGANDFNWYFTAGHMTQDWRYYITKQGWNPSQKLSREAFDLQPFCVIKGGFAPGSNTHAKHRCNIPADRSGYHVILSTWNIADTGNAFYQVIDAQIQAGATMNPQKVIINPFKHHHHHH

SEQ ID NO: 4586 - protein, 230 aa, Artificial Sequence
  Optimized for E.coli
MGPTSYMDYTKPGVAFFSDVNKNRLFTRNDENYINQLGRNELNTLGNVSMLDIYLSNGRVVEPHYHQNASELVYCISGSAVVSLINPFNNEVSNIPITPGQVANIPQGWWHWEEATNNNTHLFAIFDAPYPEYILGSDILTKTPVEIMAHTYCLDPETWKEAIAPINESVIIGPTDECTREREDHQGYSQPYYPETNTNYPYTVPQYGYMQPYPNYYYLGYGYQHHHHHH

SEQ ID NO: 4587 - protein, 191 aa, Artificial Sequence
  Optimized for E.coli
MGSLLNTKKTKHEEAKLLTHINHDTDTSFSSLSADEDKKKIKPIRLSANTEKKENEQSEKTNEKKETYSESEKELLSRLVHAEAKGESYEGKVAVASVVLNRTDKNGFPDTIRGVIYQKNAFEPVANGSINQEPDKESIEAVEEAMSSKDRETEALFFYNPKTASDDWIRSRKIIEKIGRHVFAIHHHHHH

SEQ ID NO: 4588 - protein, 324 aa, Artificial Sequence
  Optimized for E.coli
MAPAFAKGADISWVAGMEAQGMTWKDKKGVRRDILQILRDDYQINSVRIRVWVNPDMKDYASGYMNAEKAAELAQRAKKLGMSVMLTLHYSDSWADPGQQNKPYAWRNFTFTQLMDAVWSHTVYVMNTMKSKGVTPDWVQIGNETNNGMLWEDGKASVNMKNYAWLVNTGNNAVKSVSSSTKTIVHLANGDNGSVLNWNIGGLIDNGAQFDLIGLSLYPSPSDWQGKVDQTITNANNLIAKYGKGIVISEIGMEYNEPAASKAFISAIKTKVRNIGGGKGTGVFYWEPAATPGYNQGYNKGAWQADGKPTSALEGFINHHHHHH

SEQ ID NO: 4589 - protein, 291 aa, Artificial Sequence
  Optimized for E.coli
MGLQFLDKRYIAAIIIDAWQSNLNTEMDPADGQWFTNGPDNNGGLYGYLVDKIATKLVFDQSQKVFEVHQKAAVTGIADNRNGLTPNMTVSLKYAYQNSSTTSHTKSHSIKVGTGVDIKSKAEFLGCGGEVTFKFSFEYSHSWSDTTSTSKTETLEFSDTVPISIPVGHVMKVLLMCNEQQLEVPYFADIHLSGNSTTNFRSPVNGKKIWSTDAGTLCQWISQYKSSSDDNLIFCRDPDDPTKGLIRVKGMLTATQTVNFHVATEDITKSFDGYIPEGIAQAVAVHHHHHH

SEQ ID NO: 4590 - protein, 166 aa, Artificial Sequence
  Optimized for E.coli
MGKGDKKIIAHLNKLLGNELVAINQYFLHARMFKNWGLMRLNDKEYHESIDEMKHADRYIERILFLEGLPNLQDLGKLNIGEDIEEMLRSDLALELDGAKNLREAIAYADSIHDYVSRDLMIEILADEEGHIDWLETELDLIARLGIQNYAQAQVLERKDHHHHHH

SEQ ID NO: 4591 - protein, 92 aa, Artificial Sequence
  Optimized for E.coli
MGIDHIPCRAGENFLKIWSHLDGRDSVDCYANRGRIGFGGWWVDKIETGNNDLIYSDANGDSVRVNRWTIITYPNRPPRVNYIEILHHHHHH

SEQ ID NO: 4592 - protein, 39 aa, Artificial Sequence
  Optimized for E.coli
MANKQQKSQPKNKPETKTYGDPKKLNGPNQPSTHHHHHH

SEQ ID NO: 4593 - protein, 329 aa, Artificial Sequence
  Optimized for E.coli
MGIGVGYRDPAHPKKGAAVIVYTDRLASASTGLLSATALGKKTNVPVRIVKTGKIRANATDYKVRIRPVIAGYSVGTIEGSGSTGLIVAPTGAPATRYLFSNNHVLNPSNTDNREATIQPGGADGGTVTQDRMGRLYRYVRLNPTGINLIDAALSLPTRNNLLNPRYATVGAIPGHVTAYRIGERLKKVGRTTGRVNGTVESVYTDLQINYGGELGLLTFEDQTVIRGTTPVSLPGDSGSVWLRQSDNYAAAVNYAGTADGRLSIAFPVQWAMQVFNTRVARPNGAGRVLRVDTGSSPRSYTRQLTSEELVRLRPRTTRIRRSHHHHHH

SEQ ID NO: 4594 - protein, 267 aa, Artificial Sequence
  Optimized for E.coli
MATAIPDGSAQAVTGAAAPTAAPVLLAADEFDGPAGSAPNPVIWRYDLGASGWGNAELQTYTDSRRNAALDGAGNLVITAHREADGSYSSARLKSESTYTAQYGRIEARIRIPRGQGIWPAFWMLGADIGQVGWPACGEIDVMENVGYEPGIVHGTVHGPGYSGAQGISAAYTNPSGAAFADDFHVYGVDWRPGSITWTVDGVAYRTVTRADVGSATWVFDKPFFVILNVAVGGNWPGSPDASTRFPQQMTIDWLRVHQNAHHHHHH

SEQ ID NO: 4595 - protein, 1263 aa, Artificial Sequence
  Optimized for E.coli
MDQTITKIRAAVHSLFSNHNLQLSITDYDIDYTAYLVDCMSSDICSQEKMALLDQIKFAKRLSRKRNLLNDGDFRLSNWSDENGWRRNAHVIFASDYQGRYANMPAATTAENGTIVPTYLYQQVSESKLKPYTQYLVRGVVENSQDLEVFVLRYAKEVSKKINILNDNSYPNLLHTNRDGHQCYERYPKQIMIQNSIDRYKKPHEFTYHIDIGELNLNEGPGVCVGFKIRTTDGIATLANIEMVEVQPLKGDALARIKKREQKWKQKWIEKRMKIEEAVQVAQDAIQHLFTCPQQNRLKWTTSLTDIEYAETLISKIPYSYDQLSLGEFPMLPREAYDILQQLSAAVTKAQALYAQRNIVRNGNFRDELSNWNATGGIEVQPSQNTPSMLVIKDWSASISQDVCVNPEHSYLLRVTARKEGLGKGYVTISDCMENNTETMIFVSDEEKMVSTESLRDTTIESARIGETLDTGSPNRNYPSESFGFTPYDDQNQMMNQSPNQYEMNVYSNNVNTTNGHELGCGCRTNAHSSECKSMYTSSNHDERNAYLTNGNSITTNETILSSSPIPVQNSSFLSGYVMKTVEIFPETNRVRIEIGETEGTFIVNSVELIQIEQINEMNNQSVDVQNVAYDTTITQSNPVSFTEISASPRHTHYAYSHDSNIGYENPNWMADIPDDTMFSDLSIPGTHNTMALYGGDVTQCQTMSLNTQLYAGVRYLDIRCRHIENVFAIHHGPVYQNAMFGDVCIIVRDFLRKNPSETVFMRIKEEHTPENNTRSFSETFADYKSQYSELFWNWSSDNPKLSGIRGKVVVLQNFSGDRFGISYNTLNIQDQYSLNTNWDLYDKWLFVKDHLYAADASYKNGRKQAYLNYLSGSGGSFPYFVASGHSSPGTNASRLSTGLTTPAFASWYPDFPRVNCFIGICTIAFEGTNILTSNWIEGSDFKYVGIIAADFPGGGLIDNIIYLNIGKGTVQDGTYQIITALNNSSVVNLDLNQPHDNVVLWNNNFSNNQKWKFIYDTTKSAYQIKSVLNENLVLTWAYDSGDRDNVVATSNQYKTSQYWKLKYIGGNYRFINLVDLEGALDVNNGNTGNGTHLLYWNFQNSSNQKFRLIDTSKGIIQDGIYQIVTALNNSSVVDMNPADKNVHLWQNGNANNQKWRFVYDTSKGAYQIRNLSNENLVLAWNDFQGSNNVFATLNLFYDEHFWIIESSGDGYFYLRNRKNVNKVLDITNGSSANGTNIIVWNYQGSNNQKFRLQQLNHHHHHH

SEQ ID NO: 4596 - protein, 124 aa, Artificial Sequence
  Optimized for E.coli
MGWDVDTTKRFDEWFKAQTEELKEDMLAAIVILSEYGPHLARPFADTVDGSDFPNMKELRVQHQGKPIRAFFAFDPSRRGIVLCAGDKTGVKEKKFYKDMIKLADAEFRKYLNGGDNGHHHHHH

SEQ ID NO: 4597 - protein, 140 aa, Artificial Sequence
  Optimized for E.coli
MGSIGPVSGNGITITLPVGKTLFWTANVQASYSQYVLVRDSTNQVVIESKGASTGGHSPTQIGQGSFVTAGSGVYTVFIGYNNGQSWSQVMWDEIALNIGSQIYSSCFNFISEDGADQDFNDTCLTLTWFNSIGHHHHHH

SEQ ID NO: 4598 - protein, 463 aa, Artificial Sequence
  Optimized for E.coli
MGSSHVPQPEATHVPNIAARAKQKPIWLSEKPTPQVPQDVWERMRQGFQLQDNLGVNPRIEQQRLWFASNPSFLENAGERGSLYIHYIIERLEERNMPLELALLPVIESAYNPMAYSRADAVGLWQFIPSTGRYYNLRQTRFYDGRRDITASTTAAMDYLTRLHDMFNGDWLLALAAYNAGEGTVSRAIERNEKLGLPTDYWNLPLPAETQAYVPKLLALSQVVLAPEAYGVNLNPIANEPYFQVVEINQRMDLSKVAAVANIDEDELFQLNPAFKQRTTIDGPQHLLVPTSKAQLLTASLSTMRPEELISSRPLKPVFEGADDNEIAKLKRAYRVKRGDNLAAIAKANKVDVKDLQRWNKMTGKNLKVGQTLVMQDNTKRSAGRINTVVAASGKSKGKDTGKTVAKTQQTYKVQQGDSLYMVAKRFNVEMQHLKRWNPRVGQALKPGQMLTVSSPRHHHHHH

SEQ ID NO: 4599 - protein, 623 aa, Artificial Sequence
  Optimized for E.coli
MGKPRSSDDAKQIVDRMTLDEKIGQMLMPDFRNWKKEGESSPQAFTKMNEEVAGLIKKYQFGGVILFAENVKTTEQTVRLTDAYQKASPKIPLLLSIDQEGGIVTRLGEGTNFPGNMALGATRSRINAYQTGSMIGKELSVLGINTDFSPVLDINNNPDNPVIGVRSFSSDRELTARLGLYSMKGLQRQNIASALKHFPGHGDTDVDSHYGLPLVSHNQERLREVELYPFQKAIDAGADMVMTAHVQFPAFDDTTYKSKLDGSDIMVPATLSKKVMTGLLREEMGFGGVIVTDALNMKAIADHFGQEEAVVMAIKAGVDIALMPASVTSLKDEQKLASVIDSLKEAVKNGDIPLQQINKSVERIISLKIKRGIYSAQHDSSIDKKVKKALKTVGSKHHTKTEQKIAEKAVTVLKNDQHTLPFKPKKGSRILIAAPYEEQTASIEKTIHDLMQRKKIKSVSLNKMNFAEKVFNAEHEKQVKEADYIITGSYVVKNDPVVNDGVIDDTVTDSSKWATAFPRAVMNAALQHKKQFVLMSLRNPYDAANFEEARALIAVYGFKGYANGRYLQPNIPAGVKAIFGQSKPKGTLPVDIPSVTKPGDILYPFGYGVNIKTGKPLHHHHHH

SEQ ID NO: 4600 - protein, 86 aa, Artificial Sequence
  Optimized for E.coli
MGSQYVAYEGPGFTGRSVVIDRCGPSNIPFHGSYKWYGDGQSGRMYNQPNTQGVTHFELPSNRNAEQRTPVGWKSIFIVCHHHHHH

SEQ ID NO: 4601 - protein, 230 aa, Artificial Sequence
  Optimized for E.coli
MGLTAGVQEACAHGAIGTPIARQYQCRLEGGYWDPADGSGIPHTDCRAAYQNGGNSAYPFTQWNEFSANPIGQGDDLEKLQQAVPDGLLCAGGDKKKSGIDVPAVAWRKTRVTPVGGKIDVTWENTQSHTPSVMRIYLSKPGYNPQQPLRWADLDKIYDAPAPAPQPADGGGRLPGTVTSFYKLSVPLPAGRTGDAVLYSYWQRRDAGNEGFFNCSDITILPGRHHHHHH

SEQ ID NO: 4602 - protein, 860 aa, Artificial Sequence
  Optimized for E.coli
MAAYTDYSIYKVEPAKTFSTESQASQAAAKLEKDTGWDASYQASGTTATYQITATGIHSEAQAKTVLSGLTKQTAITGTSSPVGSKQPYMTITSGAISSEKQANTLLAKLKQETGVSGAVKMSGTAQFYMNVVTSEIAEETKVKELIQGLTKKTGIKSTYQPVTHEVSVTSIQSGAITGDSKAAQVKNAFQKESGLKASLKETAKGQAYYTFTTASISGEANAKTLLQQLKQSTGITGSYKSINQKTTADVYNVQSAYFKGLNTVKDAISQIKKNTGVSGYYQKVGKSTSYTVNMKNLTKQQLQKVDAFFKKKKWHYTSSAVKKTATSSAYQITTAQILGEQQANKAAAFFTQKKVKATKKATGKKAENQYQLISEETTDQAKVTKGLNVLKKNKLSAAAKTVKKQTANTFKITTESLLEAAKVNEAITFFKSNQISAASKKTGQTAESKYQITTEAIISQEDIDRVLAFFKKNNASGTAVKTGATAYTQYKILTSQLSSKTALNNGLNYFKALQLSANYTTKSNTLYKISLNEQFTGNSAASAASAKLKQLYGWTSSTVKIKNGPQIMKTNYNLSLRDMVQKQMKVSPQTDGAAYVSLTYINTATSTVTADVLNIRSTPAVSPTNVIGQLKKGDKVKIIGQTNGWAKINMGWRNASSDEVGQYVDPNNFSKDSKYYFQFLKLSQTAGLSVAEVNQKVLAGKGILTGKAKAFIDAATKYSINELYLISHALLETGNGTSDLANGLTYNGRTVYNMYGIGAYDSNPNYYGAKYAYEQGWFTPEAAIIGGAKFIGSSYIHNTAYNQDTLYKMRWSATAAHQYATDIGWAYKQVNRMYSLYSLLDGYTLYYDVPEYQHHHHHH

SEQ ID NO: 4603 - protein, 511 aa, Artificial Sequence
  Optimized for E.coli
MEQELNKHKPPVSTGSGVFYEIYINSFYDSNGDGHGDLKGITQKLDYLNDGKPHSGKDLQVSGLWLMPLNPSPSYHKYDVTDYYQVDPQYGSLNDFRTLMKEADRKGVKVIMDLVINHSSSEHPWFKEASANPQSKYHNYYVWADENTDLEEKGSWGQQVWHKNPNGEGYFYCTFWSGMPDLNFDNPEVRKEMIKVGKYWLQQGADGFRLDAAMHIFRGQTKDGADKNIAWWNEFRSEMEKVNPNVYLAGEVWDKPETIAPYFGPLHSLFNFDLGGTILNSVKNGRDQGIATFAEKTLQLYKSYNKAALDAPFLSNHDQTRVMSELGGDVRKAKLAASILLTLPGQPFLYYGEEIGMKGEKPDEYLREPMRWYKGDGPGQTTWEKPKYNTGEVSVEAQLRDDDSLLESYRTLIRLREEHEALRSDSLQPIQAGSASVTAFKRTSGKETMYVYHNLSGESVTLQIKDFDKGKWKVIFSTSKDVKVKKGTVTIPAYSSLITEEDRKSHHHHHH

SEQ ID NO: 4604 - protein, 473 aa, Artificial Sequence
  Optimized for E.coli
MATAGYSGYTGAASIVNGVPGKVATASLGAVVDATVLDQVVVATEAGARVTVPVSTTAAVAAEGIAGAGLKLVPYLGAALTAAQVASMLKNAGLRYGSCSAQSWFGLPAYCQQPPAADQYLWHGGFGSNSSVPYPDPTSACQGDMAALIRSNSTWAGWTMTLGSSSGPDVVGCVLVSPTGVVGSSNFTVASRYLNPNPGQLPPLAPATGDDIAGALKLQAIQDSNARKALYDAIKSDLAAHPEYQTADTNPVQPSTPASVTASPVISPTVTTRVDTVPKSDGSTDTVTTSQSTTVNPTTTGTTVGDIKTTFPSTTTTTVTTTNNVTNQTTTNTSVTSNPAPSPELKIPDDYNKEVTQKQVEKDLNTDAAPPMDDQQKVITDANTKGDTDRDKIYDDIKSGQQDKSSWFSWVWSPPVGVCAPITGVIAGFHVSWDLCPSIAIIQAIIGWLMGIFSAAEVYGQLFKREDHHHHHH

SEQ ID NO: 4605 - protein, 117 aa, Artificial Sequence
  Optimized for E.coli
MGKERGYYDVVYHQFSVEADDSPIITNSINVFVGKTTLTNDTDLEQTLSTNSFEKIFVNTITNSTTSGYNLGVTASAKFSILSIFETGIEMSTEYDFSNTSVTEKKTNINIHHHHHH

SEQ ID NO: 4606 - protein, 330 aa, Artificial Sequence
  Optimized for E.coli
MGQVPLREGYPQRYTVVAGDTLWSIANRFLRDPWQWPALWQANSSLADPDLIYPGDSLALVQVNGEPRLTLERGASRGTVKLSPQVRRTPLAEAIPTIPLQAIDSFLLSNRILDRAETFDSAPYIVAGDAERVLSGTGDRIFARGRFDPEQSAYGIFRQGKTYTDPQSGELLGINADEIGGGEVVAVEGDIATLQLQRTTQEVRLGDRLFSGEPRVINSTFVPSPPSRAVEGLIIDVPRGVTQIGALDVVTLNKGRRDGLAEGNVLAVLKTGETVRDRVAGGQVKMPDEGAGLLMVFRTYDKLSYGLVLNASRSLAIMDKVRNPHHHHHH

SEQ ID NO: 4607 - protein, 109 aa, Artificial Sequence
  Optimized for E.coli
MGQAPTPDQARQQQPVFQGQSTRTVPQLSDCIYRGWSTTSVIARDNTTHTQPDGSEISVFTWEDSIFADVSPRRKGSDVKYFTTFRMAPQVMADRQAIVERCLHHHHHH

SEQ ID NO: 4608 - protein, 108 aa, Artificial Sequence
  Optimized for E.coli
MGSKDTSSEHLRAELKNLADTLEEVLSSSTEKSKGELDKLRNKARVALDSSRERLGESSERIAATTREAAQKAEGYVRENPWHGVGIGAAIGVALGMLISRRHHHHHH

SEQ ID NO: 4609 - protein, 364 aa, Artificial Sequence
  Optimized for E.coli
MALPPQASLDLFGSKSMRTTQESVVPDLKVYPGGQTIGVKVKSSGVLVVGHHIIQESNDRKVSPGETAGIRLGDRITHMNGKPLNSLARVAEAVDEAGKNKKPLDITLCRGEQTISTKLTPAYDQDDKAWRLGLYIRDSAAGVGTLTFYAPDQGVYGALGHVITDMNTQTPIVVGSGEIVQSNVTSIAKSQSGEPGEKRAHFLKDHRVLGNIERNTNFGIFGKMSDEPQYGLYSTPIPVALANEVKEGPAEILTVLEGQQIQRFQAEIVHISQQDKPATKGLVIRIVDPKLLDKTGGIVQGMSGSPIIQNGKLIGAVTHVFVNDPKSGYGCFIEWMLRDAGIMQNNVSLKSSSNLKASHHHHHH

SEQ ID NO: 4610 - protein, 308 aa, Artificial Sequence
  Optimized for E.coli
MAQTDLTSLTDESQEVTLENGSLSSKIAVLEVSGTIQDNGDSSSLLGSDGYNHRTFLKNLEQAKEDDAVKGIVLKVNSPGGGVYESAEIHKKLEEVKKETKKPIYVSMGSMAASGGYYISTAADKIFATPETLTGSLGVIMESVNYSKLADKLGISFETIKSGAHKDIMSPSREMTKEEKNIMQSMVDNSYEGFVDVISEGRGISKAEVKKIADGRVYDGRQAKKLNLVDELGFYDDTIAAMKKDHKNLKNASVVSYEESFGLGSLFTMGANKMFKSEIDFLNMREVLSQSGSPRMMYLYAKHHHHHH

SEQ ID NO: 4611 - protein, 95 aa, Artificial Sequence
  Optimized for E.coli
MGIGEVACGNRDDFVKLDISFGNGMGTNKCFANAGVTGTNIGGVYNVFSGNNKVTVNYERNGRYETSTLGYWQGVGFSGTVRVYEVRIWHHHHHH

SEQ ID NO: 4612 - protein, 68 aa, Artificial Sequence
  Optimized for E.coli
MGQTTDKEKNGHHYSGGPKTEVPHHMGKKDTTGSSTKATSGGHHYTGGPNTSTPHHMGEKTKHHHHHH

SEQ ID NO: 4613 - protein, 173 aa, Artificial Sequence
  Optimized for E.coli
MATTSGTINATLTLTTGCLVNGQSATAGVNFGTLNFGSSAATFDTLNATLVGAAGNGIFVRCTTGQDYNVVVTSSNAAPATIYGTASASPRYLVLGSDNAQGIAYTLYSDASFTTAIANNTPIAASGTTDPTLGTNYAIYGRVVGGGFNPLIPAGTYTDTINVAVNYHHHHHH

SEQ ID NO: 4614 - protein, 80 aa, Artificial Sequence
  Optimized for E.coli
MDKYSTVTITKGDTLWELSNKYHNHHHLTTNEFVKWVEDVNDLNSDTAQSLSPGDKLYIPVLKKELHNQVAIEQHHHHHH

SEQ ID NO: 4615 - protein, 1555 aa, Artificial Sequence
  Optimized for E.coli
MAITGVSPMTTLNNMATAAAEAVADPLPLQGPGLGNLTYTSAELFKPVSMITSLAHPLDPAHSSAYESREVPATYPGRKDYGMNAGIMVNGYFLTSFAPDSGLGPGGFLLYDVSNPRQIQLVKKIYEPEARTKEFRETHSFGTAKIGGKTYVVLPSIYGVEFWDFTDINDIKQVKKLALPGVNAGDYEDVSWQLWWQAPYLYVASAGRGIFIVDAGDPVNAVVANRGAGKPNPVPTGELGNFRIGPIFTMGNHMVLTAMESNGGFASLDISDPLNPKVLDSIVGTTPFYYATCFDGRNLHASTRGSGARMYSYDLSDRSRFVAEDNRLVIDEQLYCATQDNYVIQGAQTRIHKVDVSNPLNHVEVGRGSILREDDPNFSHSDNGQVAMFGNLVFVGNDHGSGSGFVVHAVDPDTTRPEVKQVSPANGAKQQALTSRIGLGMTDSIRPESVNANTFIVRAVGGNTLAGTYSVQLGIINFHPEQPLSPGTSYEVFLPANGVKDYAGNAIGADYKSTFNTGNATDINLMHYWTLAGNLSDQIGNNNGTPVSGDAFESIGMSFANRTAGVPLKNDSVATVLGGTASLSFYMKTTQAGGPNSWTAPGIFGRDQSGGADDVFWGWLDGNGRIKLSVGNDAGTTSTAVVNDGSWHHVVLTRDAASGAQAVYVDGVKTTSTGLTGNKGLSNKFQVLGQIQGNAALFKGTLAEVRVYGRVLTDSEVGTLRGQAIIGDPGIGGGPKIVNGQLVFDPATLGSSGAQFRWNFGDGTQTAYSTQPRYTYTYTRPGHYTVTLTVRDASGRETFYTYNLTVIVPVTARAPTHTTNIAGDANSVYSLNPDSGTVAAIDAQTLAKRWEVRVGDEPKTLAVGPDGRIWVTVQGEDKLVALSAADGSLSATVPLAYGSGPYGVAFTPDGAKGLLTLESKSVLMSFDPSNGTTTGAVALEGSLRGIAVSSDAQVAYVTRFKSRMTGGQLHKVNLQSMSAMPTIALPVDTTTVDTESRARGVANYLSQVVISPDGRRAVLPSKKDNIVRGRFRDGVDLTHDQSVRSILSQVDLQAAAEVFDEQIDFDDRAPARAALFSPPGDYLFVAQMEGNRVAIVDPYSRAVRGEINASSAPHGLYLDAARKRLFVNNFLARSVSVHDVASVLSSESAAAIFLQNVSTVAQEPMAAAALRGKQVFYNASDRRMSKDNYISCASCHADAGDDGMVWDFTQRGEGLRRTISLMGRRGAGHGKMHWTANFDEVQDFENDIRNEFGGTGFLTNADFAATADPLGAPKAGKSAQLDDLAAYLSSLNKYMRSPARAADGSLSVEAVRGQTVFNTAQCATCHTGGTFRDGLRHDVGTIQLSSGKGINQPLAGLGFDTPTLSGTWNTTAFFHNGQAATLQDVLNSGHGNASSLPAPDVVALREYVRSLDTAPAVVTRIRSDLNPTMCVNIKGGATASGTVAVQWPCGTASNEKFTVTSITGGYVQLVAEHSGLCLAQNGTATTNAPVVQLACTAGSTAQWSLVGGTLRNRGSGSCLDVPNGSTTQDTALITWTCNGGNNQNWTQLPHHHHHH

SEQ ID NO: 4616 - protein, 325 aa, Artificial Sequence
  Optimized for E.coli
MANAAVYHVIISKGKLGNKSLAITASDKDDSVFISSHEYGNEYQLWEKRSVRSGDSSAYALVNKKTGKCIGRRSVANGSELYLEAASQADTSDIMVWKDDSVAGTYNAIKNYADWEQKINVPHSRFHEGQKLVTWEWSNAADNELWLFLAEKKNIKIKHMDFQLEGVSPQVDQPLVTDKQIVKNTTGIDQTQVLTLSYSKGVSYSFNTERSLKISETLEFKAGLPLLGETKVKIGVEGTRKYSETNATDDTEELTLEVPVTVPSGKTIEVSAIVMQGKLDVPYTAVFEISYPDVTVEETVSGIFSSVNSYSVYTEFKLLHHHHHH

SEQ ID NO: 4617 - protein, 102 aa, Artificial Sequence
  Optimized for E.coli
MASSDVSILINRTNCNQNDYFEIHNNNGRDTLCFANAGSMPVAIYGVNWIESGNNVVTFEFQRNLSEPRLETVTLDKWRSWQPGQPSIHRVTWIRIHHHHHH

SEQ ID NO: 4618 - protein, 129 aa, Artificial Sequence
  Optimized for E.coli
MGQGHEPAAAVPKGPSLNDASHPDHALHNAGRSKLPSVFSEEAAANITLHAKQNGIDAADKLQSIKVQDGKPFVMGTTPGFRTAVDLAQAPPSLEQTSAKLLADPSHQQQVHEEQQRVAMGGRHHHHHH

SEQ ID NO: 4619 - protein, 484 aa, Artificial Sequence
  Optimized for E.coli
MGSDGGSSGVSSASLQQVSAKASAPACAAAWVASAIYTGGNSASYSNVNYTANWWTQGNNPSTESGPIGSGKPWTSAGACGDAAPPVTPPPVTPPPGATTGTINFHLLLGAGSAQDQLLLDGGNYNDLIMSNIVAGVMYGHLLQQYYPGMQFQKDYLYGSILGQLLQENIATGLYVSSGNLIDPSPDQQAVMATGQGGPYQINNYAADMVSGSYAPAGHSLINYVAIQKNIGYTMANAAQQYSKPTPPSFNNKYYGPMLTAYFHYNDFVALIVTGKGMGGWTTPWQPDYDNALVKFTKLPNNFLDVLLNVAYNQGFYGTLMSSYSKLAATATASTVTSVNAYSSVWGATDTYKQYPYQVRYYLDQLYDNPIPTTSATTFVTPANHVAFGVAALETVFSNVFQTLAYVNGSGQSAYISAAQAQAAFNSALATAEVAAGATLDLSNAANRAQIFSVLEKAIGNLETSLNTKFNATTSVQLHHHHHH

SEQ ID NO: 4620 - protein, 194 aa, Artificial Sequence
  Optimized for E.coli
MAPLPTASLHVGTTYARWLWPVQAVRGQTNAASVSLQILPSQTVNVGGKVSFGVTARRTGYLILVDVDAEGRMSQIFPTPELLAQSNERDINLVKPGVEFVVPAPAARQRGFEYVVAPPAGSAVMIAILSERRVQLLDLPDMPRKLEGQADALSYLSAWTSELRVPDNSSGKLVTNNWSFDVKSYSIKHHHHHH

SEQ ID NO: 4621 - protein, 830 aa, Artificial Sequence
  Optimized for E.coli
MGDILVQGSQLQAGGDLRLTAKNDISLLSAQNSERTDSTNSSKGGSLGIGLTAGSGGYGISVSASVNAGKGRENGNGLTHTETTLTAGNGLSLNAGRDTMLTGAQVRGDSVKVDTGRNLTLTSEQDSDRYDSKQQNASAGGSFTFGSMTGSASVNLSQDRMHSNWQSVAEQTGIFAGKGGFDVTAGEHTQLNGAVISSTATADKNRLDTGTLGFSNIENHADYKTEHQSVGMSPAGSTGSQFEGNMANGLLAGLNGSGSASSVTKAAVSDGTLIIRDKAKQTQDVSALSRDAAGANPGLDKIFDKEKEQRRMETAQLLAEIGSQAGDIARTYGQIEATKAATEKMKTVTPDQKKDAEAQWRKANPGQEPTAADITGQVYQTLYNREMLAGGMGTGGSVQQGISAATAAIQGLAGGNIAQAMSGAAAPYLAEQIHKLTTTKGPDGKEVVNVQANLIAHAVVGAVTSYASGNPALAGASGAAMGEYIAQQMYPGVKREDLSEEQRQTISALGTLAAGLAGGVAGDSTGGAVAGAQAGKNAVENNALHAPDEKKRQDAKWSLPYLEGEKKQQAEQLISDLDAKDKAFDVALDSACKGLSSAACQGMRQELAAMGKSYSEQLDGQYIGNMGSVYKEGKGQVDALIWQYATADAKAERDANVNRIAENWGVSKETADGLYTTMAGVHTAAAIGGALWGLKGPGTVTVYRVEGTPNTRVVIGDNGQVSITGNTTLYLNFGDKARALEFFEKRGSQNMDGAAIKTFEVPHSVLDDLRNTVVKESVARLPENKGKPVIADPTKAKDQYGIRPEKLEELKDKIIQGTGRNASKHHHHHH

SEQ ID NO: 4622 - protein, 225 aa, Artificial Sequence
  Optimized for E.coli
MGYQAYTLSDDQVKQLSDKSCEQMDKDNQIAPANSDYQQRLNKIAAALGDNINGVPANYKVYQTKDVNAWAMANGCIRVYSGLMDMMTDNEVEGVLGHEMGHVALGHTRKAMQLAYATTAARTAAASVGGVIGSLSQSQLGEMGEKLVNAQFSQTQESQADDYSYDLMKKRNIDPMGLATSFEKLAKMEQGRQSSMFDSHPASEARAAHIRERIAADSKHHHHHH

SEQ ID NO: 4623 - protein, 715 aa, Artificial Sequence
  Optimized for E.coli
MASASERSAVKKGKVAATAKKAEKKTTKKTAAVKAGKKVASRKTATAPVRVLNVRPDGLDFRDTMYIPTLVEVPVRRELSDYRETRVPVLDQGQENACTGYGLATVAHYLLRTRRYQSDATLVSPHMLYDLARRYDEWAGEADEGSSCRGAMKGWYKHGVCPAPQWQAGNQATTLTQVLAEEAALRPLGAYFRVNHTDIVAMHAAIAEVGVLYASASVHEGWHVVGGDGHIQPSANILGGHAFAIVAYDQDGFWIQNSWGETWGYEGFAHLRYDDWLANGADAWVARLGAPITLRVPLQASSQAKAVAAASSSETLREIRPHVISLGNDGAFDPRGDLATTAASVEEIFAVDFPRITAGWAKKRIVVYAHGGLVAQAGAIETVAGYRAAMLQAECYPLAFIWKTDYWSTLGNMLADAARRRRSEGVLDATKDFMLDRLDDALEPIARLLTGKAEWDEMKENGLRATVSANGGARVVAKALARLAAQGVEIHFVGHSAGSILLAPMVQYLVSRGAMNSGPMARSQLKGLEVKIASCHLWAPACTVKLFRETYLAPIRDKRIEKFGLFTLTDQAERDDHCAHIYNKSLLYLVSDAFEDKVRIPLIRPDGEPILGMERFVTGESDLAQLFASASNADWVRAPNDLPMGNQNASGARHHGDFDNDETTVRATLARILGQGGARHALVLSQPIAERAQRRRQVDLASSIGRRQPHHHHHH

SEQ ID NO: 4624 - protein, 821 aa, Artificial Sequence
  Optimized for E.coli
MGQSAQTFNAPMPGAPATPDAQARPPGGILSPFLLSAQLGRDLMLHYAIDNNNANAAGVPCADLGADSASCATGRLILENRGQARISGDGWKLYLHSIRRLLRIDHPGFTLRHLTGDLYELTPKPGALTLAPGARLTVPFVAEYWFLRYSDLLPRPYVIVPGALPTVLRHNDTDDETRYVDSLPADAQSSSTGNAPPAAVQPVASRALPSVKRERLGNDTVELRGVQLALTGLAANHVAALRERAGELGLGGSGLPVRGSIVPQQLPADIAIPGGYRLSITRQGANIEAYDQTGLYYGVQTLFSLTPAGGGRIPAMQVEDAPRFPHRGMHADLARNFKHADTLRKLIDQMSAYKLNRLHLHLSDDEGWRIEIPGLPELTAVGSRRCHDPSETLCLLPQLGSGPDNRSGGGYLRRDEYVSLLRYAAERFVDVIPEIDMPAHARAAVQSMEVRYRLFHALGREREASEYRLIDPQDTSNTLSVQFYDRRSYLNPCAPGSLKFATKVIREIAAMYADAQAPLPIWHFGGDEAKNILLGAGFQPLNGTDPNKGRVDQAAQDLPWARSPMCTALLQRGEIKSTEELPTRFAQQVSAQVAANGIGTMAAWQDGLKHANGPQDFSTRNTMVTLWDTLFWGAADSARDWSAKGYRTVLALPDYLYFDFPYTTNPRERGYYWGSHATDEYKVFSFAPENLPQNAEVIGDRDGNPFEVTGTGAAPRLEGMQGQAWGEVMRNDGEFEYMVYPRLLALAERAWHRADWERPYAAGVRYKLGDTHLVDKDALNKDWAGFATVLEQRELPKLGRAGIGYRPPTFSLSGSHHHHHH

SEQ ID NO: 4625 - protein, 276 aa, Artificial Sequence
  Optimized for E.coli
MGEIRLYTDDNFKGRVVVLRDTTDDLSRVNFNDTVSSIQVDSGSWEVCTHADFKGDCKTLERGDYRSMPGMNDKISSVRETGAGQGSGSGSGGGRRAALELFADGGQRGASAGVNSDRDDLVDISFNDRASSARVEYGYWQLCSDSNYRGSCRVFGPGSHDDLGSLNGRVSSARLVDPREENRPQNDEGLVVLYGRAFLKGPGLQVNRDVSDLVRLNFNDQAASLAINEGTWEVCTDSQFNGSCERMGPGKYEVLNTTLDKRISSLRRLYHHHHHH

SEQ ID NO: 4626 - protein, 202 aa, Artificial Sequence
  Optimized for E.coli
MGHTEYSRTAMQHVDMSVTGIPTILGLGTLGTSIPLTPEYSLTAAHVAKTAVQRVKSYHPYCDLAIIYHKNDASTLTKFRNSDIGDPVKMYGYSFISAMPVESTGVNLARTAIRNNWNKSPCIAMASNAGVVQGMSGGGVYNRDDTLGGVIVGYSDSIKNGRNNKVILKDVSLYIPYGQFKSWLESNLAQTPTRGAHHHHHH

SEQ ID NO: 4627 - protein, 174 aa, Artificial Sequence
  Optimized for E.coli
MAETTHRVKAGETLYKIGAEYGVTVQQLKEANHKSTDSINANETLTIPNSISESDKELLARLVQAEAKGEPYAGKVAVATVVLNRVDSDSFPNSIHDVIYQGTQFTPVQNGEINKAADAEAKKAVNEALAFRGQGKGSLFFFNPDKTSDQWLRQKQVTITIGNHVFAKHHHHHH

SEQ ID NO: 4628 - protein, 344 aa, Artificial Sequence
  Optimized for E.coli
MGHTVSPVNPKAQQTTKDVMNWLAHLPNRSENRVLSGAFGGYSHDTFSMAEAERIRSSAGQSPAIYGCDYARGWLETSNIEDSIDVSCNSDLISYWKSGGIPQISLHLANPAYQSGHYKTPITNDQYKKLLDSSTTEGKRLNAMLSKIADGLQELENQGVPVLFRPLHEMNGEWFWWGLTSYNQKDDERIYLYKQLYIKIYHYMTGERGLDHLLWVYSPDANRDFKTDFYPGASYVDIVGLDAYFQDPYSISGYDQLTALNKPFAFTEVGPQTANGNFDYSLFMSAIKQKYPKTTYFLAWNDEWSPAVNKGASSLYNDNWTLNKGEVWNGNTLTPIVEHHHHHH

SEQ ID NO: 4629 - protein, 342 aa, Artificial Sequence
  Optimized for E.coli
MGKKLEPKEAVTTGTANAMKLNSYESKSQFTIKELTITSASVPSEQSAMVTSMLKNADITLDGVYQKEPFQSEMTLGIHLKGDLSTSFTIPMVMTKDKLYVKIPNIPFYPLPQDVVGKFLIIDPQELAKQSGQEFNPAAMDQEKSQKFANEVIAAIMNEYDQATYFFDIDPKDAKLPQGVEAKQVVQFKITNDNVKQATNTFITKALPKVLDVMSKDEYAGMLQVKKEELAEAKKELQSNTSEVSKKLDELKNYLTVKQFDINTALNKDNIPVYQDLNANVEMNDPATKDNVKLSVTGYTQYSKINAKAAFKVGIPTGDQVLTMEQLQQKMQTVAPHHHHHH

SEQ ID NO: 4630 - protein, 294 aa, Artificial Sequence
  Optimized for E.coli
MGSIKVDITASSDNHQTIATATGNDISVISNEERGTFQLNDQQLKRAVEVYFGKKPNDAYLSSPTPWGDLYKTYNWQQVMRTLQPVSTRVISQNSTPVIVMEQDFVNNSSVPAVYNVKISQSVQNTVKSSWNTGGKLTVGQKVKYGISFLGTGGGGESSISYEQSWGIGGEQSTTITLGTESGLQVTLQPGQAVTAELVASRGSMKVQVDYQASLSGISAVNYNPTYKDHHFWGLPITQIMRSSNISNAIVSSEIIDIGFYADSKVILRDKNTGGVFRTFNLFDKHTDHHHHHH

SEQ ID NO: 4631 - protein, 121 aa, Artificial Sequence
  Optimized for E.coli
MEQPKVEVFQIETGKVVRSTPKPPSVQKEAEKSITSITGLYKKASPLPKKGYLVKVPLDPAVKIENSAVNTLASEVIFVLEPNQKPIMMVFDNENRTYFFEFTHDLTLLRKALQLHHHHHH

SEQ ID NO: 4632 - protein, 237 aa, Artificial Sequence
  Optimized for E.coli
MENRETGTAPATQPPSASAPPANPSAKPTTTETLPPPTTAPAEPLPSAVPPSSSDPAPAADPVTFTFADGRLSFTHPAGWRVEHSQTVASPSVQNATVYDTSGNEQIGIFYSEVGGGVAGPHTRTVFFSEPVPGLQGHSGPASGPATAHVSFYVDHIYGEPHYSLSLTHREALSPDGTEGADVVIVGGNRVLAANVVFTGGPFASDEAAKAWFAGTEGQALKAILMSFSYRHHHHHH

SEQ ID NO: 4633 - protein, 131 aa, Artificial Sequence
  Optimized for E.coli
MGRLQKYTSNCNKYVIIEYQVSYYSQQIQADIMSLPATLQARYLSLTARMKIYGPHLGEPHTKVLGNGLLELRLKGAEGIARVFYCTMVGKQIVMLHSFVKKTQKIPFKEKRIAEIRMREVKNERHHHHHH

SEQ ID NO: 4634 - protein, 868 aa, Artificial Sequence
  Optimized for E.coli
MGNQQVVDQLSQLQVNLKMLDNRAAENGVDCAKLGADWASCHKVLITLTNGNQEIKDKDWAIYFHSPRQTLKVDNDQFKITHITGDLYKLEPTDKFTSFPANQAVEIPIIAEYWQLFRTDFLPRWYATSGDAQPKILSNTDTEDVNQFVAPFTGDQWKRTKDDNNILMVPESRFTKNQDLKVLPMASLRGQIIPTPMEVKVHAKDIDLSKGVALELSALTKPAADAAAERFALLGIESQANGYPIKTDIKPAAFKGDQAVPGAYQLKIGEKGAEIVGFDQTGVFYGLQSILSLIPSDGSKKIATLDAKDAPRFQYRGIFLDVARNFHQKDAVLRLLDQMAAYKLNKFHFHLTDDEGWRIEIPGLPELTEVGGQRCHDLSETTCLMPQYGSGPAPHGGFFSRQDYIDIVKYAQARQIEVIPEIDMPAHARAAITSMEARYKKLLAEGKEKEANEFRLVDPTDTSNTTSVQYFNRQSYLNPCLDSSKNFVDKVIGEVAQMHKEAGQPLKTWHFGGDEAKNIRLGAGYTDVKNPEAGKGILDLSKEDKPWAKSQVCQAIIKDGKVEDMEHLPSYFGLEVSQLVKAHGIDRMQAWQDGLKDAKDSKAFATKHVAVNFWDTLYWGGFDSANDWANKGYDVVISNPDYVYMDFPYEVSPDEHGYYWGTRFSDEQKIFSFAPNNLPQNAETSVDRDGNHFTAKSDKPWPGAYGLSAQLWSEVVRTDQQMEYMIYPRAVSLAERAWHRASWEQDYKAGREYKGGETHQVDTKTLDQDWLRFANLIGQRELAKMDKAGVSYRLPVPGARIIGGKLEANIALPGLGIEYSTDGGKQWQRYDDKARPSVAGDVQIRAISPDGKRFSRAEPVKAHHHHHH

SEQ ID NO: 4635 - protein, 640 aa, Artificial Sequence
  Optimized for E.coli
MGFVFIPAAGAGQPLATTYPNGEIYNYPIRSIISFASSVDVIGSKLAQSLSSSVFQGESLDEKTLGSSFGGRHNTTLTYLDGATILSNVNSLKRSKILLDAGVPLLIRVDRNQLEVGKQVAALFGVSIRSGYMLLSKDGPAKLTVFNLQAPDNTAIPNGLMQALGAVKQKNVLPSLRANIRALETDQVGIPKVTLNLNSADVTGQIVSIVNLDLIRSASRGNDKKFIVVKATPTVRSTRNGVVIGSAPNNNLWGAYLPHQYSISHEVSGTALTPILVSSDPPSDSRTEFTYTETKTHGFTIGGSFGAEGGGEHTDKWKYIAKTPFNINAGISYTNTKTLTNIFKDYSLLAAPAIGKIKWDLFIDPKLKFVLVERETAGLPTLNENRMTPMMRSASMETYSTWELPGNYEGLATLKIGGGYILDRREWWYDRSDVKRRYETDTFETLDDIILDFGSPYLTREMTVLIRSADGHGKCVGDQSGQAKLLSCSPADKSQLWGLDSESRYVNRLSGKCLTADVQSGELKTAACGIDNAQQWDWRADRIHSRYDRNWRLYSTADMLKVIPDSSMLFEDIPLNSFNRLNIPWASYPGAPSANDVMPNLNGPSPQISPDWIGKYHAADARQRWNIEILRDGIHHHHHH

SEQ ID NO: 4636 - protein, 746 aa, Artificial Sequence
  Optimized for E.coli
MATYGTVREAFNNTAISPDGEPKAADFDAAGRSLSATDLDKAGWRRGTRVTVGATTYTRADVAPGQPDNVLATGQTLAIQGAGNALGFLASATSGPVAAPVTVTYTDGTSAQQTLEVPDWSAGTTTTAALSLAHHNTPSGQQTSPARLHAVTVPLDPRKTVTSVTLPKTGSSAAPGAPGLHVFDLSVRSTPSAPGGKFWAGSWGASFGSAQPVAQPGWAQQTLRMVVNPHTSGGTARIRFANTFSPQPIRLGHVTVAAQAGGATAAQAPVSLTFGGAAETTLPAGGEIYSDPVTFPVTAGKNLLVSIYLPDQVTTVPTHDYALTTSFISNRQSGDHTADTAATAFPGTLSHWTLVNGIDVAATENIGTVVTLGDSQTDGAHSTPDRNQRWPDHYAAALNATSRPTGVVNAGISANRLLTDRADIAGPSALSRLDRDVFAQSNVRTVVVYEGINDLAHDNASAQAVTEAIRRISARAKARGIRVVVATLPAFGGYSAYSDAKETARQQVNAAIRTMTEADAPTDFDLATRDPDMPSQLLPSMLKPGGGDHLHFGDAGTKALADTLVRAADGPSVTMSQTAAADFNGDGAQDLVAREDSTGILKMWLGRGNGTFASSTDVTAGWRAFSQTAAADFTGDGKADLIARDSSGTLKLWKGHGDGTFGSAITVTGGWEFTQTAAADFDGDGKADLIARDSSANLKIFTGDGKADLIARDDNTADLRSWAGHNDATFARPTTVTGGWHHHHHH

SEQ ID NO: 4637 - protein, 401 aa, Artificial Sequence
  Optimized for E.coli
MAEVCTGTASVYGILGDGRLTYSAINTKGDRLKTLIGPDLGFTPKAMATLNFNTILVTSTAGALYRVDVLTNNNALELSGVEKIADSGWTHDKLAYDGYGHLYGTTAAGNLLQYLVSQDKPQGSQHIGQRKEIGTGFVLKTLTATGKDRLLATAADGRLLSYKIIGSAWKRDDLKNDGWSAFDELTSSGGGFYFGRIPTTGAMYWYKDGNISDGSGSDIVYHTNDPVDTSGWTQKLLSAAPDTTSCKQVNTLGQDIAADANREVGNNFNDFDFNHARAWCAEFVEYIWAGNSVDHSRELDARAISLKEYGQRHGTYRTSGPKVGDAVLYDVDRNLNDGEADHVNIVVAVSADGTQIQTVGGNESGKVSKAGWFNWDTASSPVGAGPVLAFVSPKGHHHHHH

SEQ ID NO: 4638 - protein, 179 aa, Artificial Sequence
  Optimized for E.coli
MGIVDYGSGDDVPAADAALVLGAAAWGSKPSPVFRERINHAVKLYQSGKVRWIVFTGGTPEPGYPAEADVGREFAARQGVPMTAMLVENQSRTTWQNLSNARDLGNQFGIRSYLLVSDPLHMRRAVLMAGDLGLRAYPAPTLSSRFRTLASWSRFLARETWLYVGYRVFRQLSHHHHHH

SEQ ID NO: 4639 - protein, 333 aa, Artificial Sequence
  Optimized for E.coli
MGSNQGAFIALNQTLSTNDYLVSNNNAFFAIMQGDGNLCVYRGSAPDANQGFLWGALGQSQPNGNYFSIMQGDGNLCVYKGTGPSDNQGFVWGALNQSQPDRAYFAVLQDDGNLCVYKGTSPSDNQGGVWCSTAIDPVVDIEISSINYDVAAAKIIKSTPADLYRQSVTNNTAQSQTSSISGSESVSETSGWSDSLAVKVGVSTTFKTGIPFLAEGKISVSLDVTNTYTWNGSTTRTKTWSFNTPVTVPANSTYVALIAATVSTISVPYTLAGTLILKSGARVPGIVRGMYTGSNSHDLTVTYIKQDATTLNIESITQPVEYAKLVAHHHHHH

SEQ ID NO: 4640 - protein, 522 aa, Artificial Sequence
  Optimized for E.coli
MGKNLANLPVMSQANALAQGMNIYGTRDTSSFIKLLVTPSKAPNKTVTFLGKDYQIPSYVNLLENTETYYDAGAYNSREEVQNSLGAHVGISGKYGAFSGEMEADYSQAYHKNSQFDYAYRNFYTQVATLQYQYDPQYLSSEFLSRLSDLPYESDTDNLDIFSEFFNDFGVFFTSKVVLGGTLQFYISVDKQSQTSTNEISAMVKAQYEALFSSGSLDANIKISDAWKRYSTNSNSTLKATGGDPEKISRIVMIDTFEPSKETVEAFHEWVSSIASDPAIIDFSLEGIWQICGDKRQAVQSAWEKYSDIMHPRMTIRTSSQVIEYPIEIEPVTPSIYIGSQSFKPNDTPASPAGFQVLILSGSNISEVIFNKYYAIPPVQYWYLPSLEVWDDFVKDVQGKHDSSNNILILVTFGLDLGMTPSSDAIDVLRSAGAGSGLVKWVKGCSPPSQAPTPSWVSYPAMYSLTGIFGNGPDTGVEYLKYSGWDGVYSDLSLDLSIYFYRQTFSGNYTFGLGELHHHHHH

SEQ ID NO: 4641 - protein, 406 aa, Artificial Sequence
  Optimized for E.coli
MGWEKYGIHSVYPAAISVQINPSQISNQQLAAIKDAGFEYVRFGTRPPVSDKPQDFSELLERLRKAQLKPIITLFGGATVWVQPKRMMSATMTPLDAADNFSKFALTTLNQYADPNILWELWNEPDNPTFLKPGMLQAGLVPAIQKICSALEQQKGGVKKNIFGFGFAKLPNLQPKIPDDKLLAISLQNCLSGVSVHPYRKIPETLADDATKSRELLHKYGKGELPMIASEWGYSNFTAARDQGGQAQLVLREYLSTVFAGIPLVNIYQWQDTGSDRAAREQNYGLTDSSGQVKQALPALKHLLGKLKDTQLAGSEKVGEAYQLVLNSQPGAAAKRSVHVVWSSAARSGPGGGFSIPRNKGQRCIISEFYPQQGDKPCPEGAGSVDINAGPSPLAVTLYDHHHHHH

SEQ ID NO: 4642 - protein, 105 aa, Artificial Sequence
  Optimized for E.coli
MAPQAHADSSPAPAMLLAQSLPGSSNNNPYNSPIRRANPNSMQGTQPSAPAVRGVNPVPVQRPPTLENGGIGNGYPRTITQPRIIDPTPVTPPRNQQQRHHHHHH

SEQ ID NO: 4643 - protein, 720 aa, Artificial Sequence
  Optimized for E.coli
MAETNPHASHSALPSGQAKEANVTGEANQHENKKNENPFFYQSRLPFQAPPFNLIKESDYAPAIDAGIKQKREEVEKIANNPAKPDFKNTFVALEQAGALLTRVMNVFGAMTSANTSDALQKLDEESSPKLAALEDAIMLNSKLFERIRAIYQQRDALKLDAESRRLVEVTYKNFELAGANLSDADKTRLKALNQEAATLSTQFSNKLLAATKDGALAIADKGKLDGLSESELAAAAQAAGERKLDKQWLLVLQNTTQQPELQSLKDRDTRKALFDASWNRAEKGDGNDTRQTIARLAKVRAEQAKLLGFPNYAAWKLQNQMAKTPDAALSFMRNIVPAATARAEREAKDIQAVIDQQKGDFKVAAWDWQFYAEQVRKAKYDLDESQIKPYFELDNVLNNGVFYAANLLYGISFKERKDIPVYQPDVRVYEVFDKDGKSLALFYTDFFKRDNKGGGAWMSNFVEQSKLKGTKPVIYNVANFTKPAPGQPALLSYDDVITLFHEFGHALHGMFADQEYPSLSGTNTARDFVEFPSQFNEHWASDPKVFAHFAKHYKTGEAMPQELVDKIKKADKFNKGYDMTELLSAALLDMHWHMLSADQPQQDVDKFEAESLLKDKIDLSYVPPRYRSSYFKHIWGNGYAAGYYAYLWTEMLADDAFQWFTEHGGLTAENGQRFRDMVLSRGNSQDLEKLYVDWRGKEPSIEPMLINRGLKDEHHHHHH

SEQ ID NO: 4644 - protein, 313 aa, Artificial Sequence
  Optimized for E.coli
MGKELSDPVLSKRMELYHKVEAVTQIPWYALAAVDQYEENVRSNRKDLPDKTGIISIYVPDEIWSGPENPNPKDDAPLSIKVFDGIGMDGDGDGKAEVSNDEDILYTFAQYLLSYGTDEENIRIGLWNYYRRDQTVGIISEFMKLFKAYGHIDLGEHAFPLPIRTDYSYRSTWGDARGFGGRRIHEGTDLFAHYGLPVKSTCYGVIEMKGWNRFGGWRIGIRDINNTYHYFAHLNGFAKGIKTGQIVEPGQVIGSVGSSGYGPPGTAGKFPPHLHYGMYKDNGKTEWSFDPYPHLRAWERYEYKKKKHHHHHH

SEQ ID NO: 4645 - protein, 59 aa, Artificial Sequence
  Optimized for E.coli
MEGGAERMKHYWDNFPISQQIPRTDSEQTSSESGKKPQAPVEDPSRTPAQPDAHHHHHH

SEQ ID NO: 4646 - protein, 240 aa, Artificial Sequence
  Optimized for E.coli
MAKKSRFYYEKKGDIVWEVPMKDEKLIALTFDDGPDPKYTPTILNLLQKYGAKATFFVVGDRITSFPKLAQREVREGHELANHTYSHLKVRGQEVERIEQEIEKADERIQAITGIKPYLFRPPTGYYDDRVVKAAKNQQYTIILWSWHQDTFDWRNPGVGKIVSQVLNHARSGDIVLFHDTGGDRTQTIEALKQILPKLKEEGYKFVTVSELLKHHPNYKSLYLMQQQKQHSVQHHHHHH

SEQ ID NO: 4647 - protein, 93 aa, Burkholderia sp.
  Derived Active Sequence
ASFDCKQARQADERAICASRALSEQDVEMSVRYEMLMGLVAMGTRGDMGEAQQQWLKRRARCGASQSCLATAYRERIDALKQQYRQLQSRGPF

SEQ ID NO: 4648 - protein, 544 aa, Paenibacillus sp.
  Derived Active Sequence
AESDGQAPQTAAASSMQSYVEAMQPGWNLGNSLDAVGADETAWGNPRITQALIQQISAQGYKSIRIPVTWDKHIGAAPNYTVESAYMNRVEEVVRWALDANLYVMINVHHDSWTWVSSMEPKHDEVLARYNALWTQIAQRFKEQPNKLMFESINEPRFSEGGTTDEAKMNQMLQELNVSFHKIVRASGGKNATRPLVLPGLDTSPAQAKINELYNTITKLNDPNLIATVHYYGYWPFSVNIAGHTTFDKDTKNDIIQTFDNVYNTFVAKGIPVIIGEYGLLGFDKNTGVIEQGEKLKFFEFLTYYMKEKKITGMLWDNGQHLNRTTYKWSDPELFNVIKSSLKGRSSNAASDLIHLKKGTPAQDAKVILNLNGNQLKTLSVGSKQLTQGTDYALSGDTLTLKASLLTSLTTSGKYGENAVITAKFNKGADWNFRVVVYDTPKLSAIKGTTQAFSIPTDFHGSQLATMEAVYTNGGNAGPQDWTPYKEFGNTFAPAYDANGIKLLPELFNSVKDGDVTLKFHFWSGDVVTYKITKSGTRVTGTTS

SEQ ID NO: 4649 - protein, 252 aa, Bacillus sp.
  Derived Active Sequence
ASAQTIKVKKGDTLWGLSNRYGTSINSIKSENKLKSDIIYIGQTLSINGKSSSGSNSGSKSSSSTYKVVKGDSLWKIANKYKMTVNQLKSLNGLKTDLIRIGQVLKVKGSTSGSASSGSSSSKKPSSSHNIAQTSLNVNKLVSDAQSLIGTPYVWGGTTTSGFDCSGFIWYLLNKQTSVGRTSTAGYWSSMKSVSSPSRGDFVFFTTYQAGPSHMGVYIGNNKFIHAGSDGVTTSDLNNSYWKPRYLGAKRF

SEQ ID NO: 4650 - protein, 78 aa, Bacillus sp.
  Derived Active Sequence
AGNDQSLSQYVKIKVQDGDTLWSLADHVAEKKHINKEDFIEWVTENNHLQTADIKPGDELILPVKKKHPAVYQLAIVN

SEQ ID NO: 4651 - protein, 433 aa, Duganella sp.
  Derived Active Sequence
AGPDTSRHQAQIDQIVKDISPVRIEGYINKLVGFRTRHTMSDTVSETEGIGAARRWIKSELERCGAAQGGRLQVAFDSHIAPVSARISRPTEIVNVVATLPGTQAASVDRMYVVSGHYDSRNTDVMDAKGDAPGANDDASGTAAVMEMACVMAKYKFDATLVFMTVAAEEQGLLGAAHWAELARQKNLNIAGMFTNDIIGSSRDEHGKVDNTQVRLFAEGLPVQKENSDAVRTLIQTGGENDSLSRQLARAVKEAGERYVPKFKVNVIQRRDRYLRGGDHMPFLERGYAALRFTEPAEDFNHQHQNIRTENGVLIGDLPQYDDFNYIAQVARVNAAALSSLSLAPAAPAKVQVRTAKLQNDTELVWQANAEPDLAGYRIVWRDTSAAEWQGSQFVGKATEFTVPLSKDNYYFGVQAIDTEGNASPASYPTPLR

SEQ ID NO: 4652 - protein, 365 aa, Paenibacillus sp.
  Derived Active Sequence
ASVKGYYHTQGNKIVDESGKEAAFNGLNWFGLETPNYTLHGLWSRSMDDMLDQMKKEGYNLIRLPYSNQLFDSSSRPDSIDYHKNPDLVGLTPIQIMDKLIEKAGQRGIQIILDRHRPSSGGQSELWYTSQYPESRWISDWKMLADRYKSNPTVIGADLHNEPHGQASWGTGNASTDWRLAAQRAGNAILSVNPNWLILVEGVDHNVQGNNSQYWWGGNLTGVANYPVVLDVPNRVVYSPHDYGPGVSSQPWFNDPAFPSNLPAIWDQTWGYISKQNIAPVLVGEFGGRNVDLSSSEGKWQNALVDYIGANNLYFTYWSLNPNSGDTGGLLLDDWTTWNRPKQDMLSRIMKPVVFVAEQAKATAE

SEQ ID NO: 4653 - protein, 476 aa, Bacillus sp.
  Derived Active Sequence
AASSVGTVKGDNVNVYRSPSLHSSIVQTVKKGEEFPVISSEAGDAAQVTTHTVVPGNTLWLLAKQYGVTVSDLIKQNQLKKTELIPGQTLKIPAKGLLHKVVSGDTLWKISVKYGVKANELTKLNQLSSTNIKPGQMLIIPDYYVQVQLLEGKKGWIKKSDLAQKKHQPVVMGWSFNEKAAGYTESMKQKNLDVVSPRWFTLTSNDKVVSSSINESYVQTAHKNGKKVWPLIGNNFDDVLTSDVLSNKAKRQKLVSSVESSLVKTKSDGINVDFENINIKNKQDFVLFIKELKAALKSHGMTVSVDVTRENNDPFWSGSFDRKQIGQVADYVIMMGYEEHWGGSQVPGSVASLPWVKEGTQLLMKDVPAHKILLGVPFYTREWKTDLSTKKVVTKDLTMKEAEAVISSKKLTKKWDSQTSQYYVEYTENGTKHQIWLEDKASMQRRVNLIKDYHLGGAAAWYIGSETSDIWELYNF

SEQ ID NO: 4654 - protein, 306 aa, Geobacillus sp.
  Derived Active Sequence
EQAEASVNYDHIVPAAKQYIGVPYRWGGTTAKGFDCSGFIRHVYQSIGIDTPRTATDMYRMGKRVDKSALRVGDLVFFNTSGKGVSHAGIYIGNNRFIHSSSSKGVTISSLNDSYWKKTYIGAKRVLAYRLAPGQFQDVSPSHWAFDEVRTLSEQELVIGYEDSYFKPDEPITRAEVAAYLAEYLDLNLSDRSVPFNDVPDDYWALGAIRAVQKQGIMNGSNGKFHPEDTLTRAQLAAVLTRAFRLQPPAAAKSFTDVPPSFWAFRDIQALAAAGIATGRTDGSFGPNEPVTRVQFAAFLYRAMHQ

SEQ ID NO: 4655 - protein, 1585 aa, Janthinobacterium sp.
  Derived Active Sequence
ENARAHGKATRAGKLPAALGSTLILLSGAMLIAPTVHAANAADATVTLGSGSVSTVGNTTTIKQNSQNLAIDWVGLSTAANEALIFNQPNSSAIALNRITGSSPSTLLGSLTANGQVFILNPNGVLFGAGSQVNVGGLVASTLGMSNADLQAGRMVFALDGNTNGSVVNQGKINAADGGYIALIAATVRNEGEINAKLGTALLAAGNKVTLNINNGSLLAYSIDQGALNALAENKQLIQANGGQVLMSAKALNTLTTAVVNNTGLIEAKTIENRNGRIMLMGDMEVGTVNVAGTLDASAPTSGNGGFIETSAAHVKIADDALITTRANSGTSGSWLIDPVDFTVAASGGDITGKALSTQLANNGLVTIMNTQGASGTAGDINVNDTVSWSSNSVLELIAQRDINFNAAVTATGTTAGLKLTYAGDYKVKAPITLSGSNSTLNINGNNYTLIRSMSQLDLLDGSNSVTNTGTARQLNGYYALAQDLDAAGTTYTKSLLGSSSSTTFLGTFAGMGHTISNLTINAAGGAGLFGLIGAGSVVRDLGMVGGSIYGANGDVGAIAGRNSGGTINNVYATGMMVGGTTRIGGILGYLNGGTLSNSYSNVTVVGGNSSSGGLVGTNSGSISNSYAEGEISGGGLVGGLVGTNNAGASITQSYASGNVIGNFGGSRAGGLVGLNSGAISYAYASGAVSGDSLVGGLVAWNYPGGSISNAYASGNVTLVVNPALSGTYAGGLIGSDSSTTTNAVWDSSSSGHVSYTGTIGSATNTTDVNAGNRYQHSAYSALGSWQETATGSGVWIAYDGSNNPQWVMVEGSTRPFLYSEWSTTVGNAHQLQLMAANLSANYTLAKNIDLSAAHGSNASGMWNATGFASIGNSLAAFSGTLDGKNYKISNLQIIKPTSDNVGLFGVTAVGSKVQNVGLVSASVSGQTQVGGLVGYNRGELSNVSVQGQISGGISVGGLAGLNMGTINASYGNAVVSSQSGFVGGLVGSNSGRISNSYADGNVSADRDVGGLVGANEATGIIEGSYAAGQVNVYQAGGGLVGSNRGTISNSYAMASVSGVAIAGGLVGVNDGTISNSYANGAVLVGVAGGGFIGMNNGAVNSSFWNSDTNSTGVGAGVNTGVTGINHAQAQLASTFVSAGWDMGTTGGTSTIWRIYDGLSGPLLRSFLTPVTVSATVNSKTYDGSGTMANGYTPVAGVTLSGSLVFTSSKNAGSYSSSDGTLQQGGLSSTQQGYDISYADASLTINKANLTVTAGSASKTYDGTTTASGTINVGTLAGAGDLVNSGGSLAFDDKNAGSGKTVIASGVTIKDAANGDVTDNYNISYVNNTSGSIAKANVTLNVTDVTKTYDGTNNAAAALAVQSGQLYGLDEVTAGSFSFNNKDAGNNKTVSASGVTVNDGNNGNNYNVTVVDSSNSTINRAALTVTANDANKVFNNLAYVGGNGVTLNGLVHGETIADLQGALAYGGTAQGATGAGNYIISANGLSSSNYAVTFVDGTLVIRPAVSVPTGVVPGELLPAYQTAIRNSDSDLRQNNDGKDEDLKVAAFQPPIEKNDAADAARPTPRLTISSCGLQLPADAGNSVCQ

SEQ ID NO: 4656 - protein, 232 aa, Pseudomonas sp.
  Derived Active Sequence
ANIAPVKANNVVLVHGSWADGSSWSEVITRLQAAGLHVTAVQNPLTSVANDVAATQRVLDQQDGPTVLVGHSYAGTVVSEAGVDPKVSSLVYVAARAPDAGEDFVALSGKYPTMPVRAGTEEHDGYVSLKQDAFLKYFASDVPHDKAMELFAVQQPIAKTLFGERTTAAAWHTKPSWYAVSSLDQTINPDLERFLAKRMGATTIELPSSHLSLVSHSKEIADLILEASGRQP

SEQ ID NO: 4657 - protein, 307 aa, Bacillus sp.
  Derived Active Sequence
STKQDQLVTEAKKHIGVPYRWGGTTTSGFDCSGYMQYVFNQIGINLPRTTSQMYNTGTSVSKSNLQVGDLVFFNTSGSGVSHAGIFIGNNQFIHSASSRGVSISSINDPHYWGSRYIGAKRVMTNTPVRSLGSGEFYDVATNHWAFSEIRQLSNNGIIGGVGNSNFAPTDQLTRAQIAALVVRATNTPLTTTANGFNDVSQSHWAAADISAADRAGFFDHIQGDSFNPNANVSRAEIAVIFSKAFDLQANGSSASAFSDINSSNWAYNEINALHSNGLVQGFTDGTYRPSSSISRAEFAKILHGALY

SEQ ID NO: 4658 - protein, 245 aa, Lysobacter sp.
  Derived Active Sequence
SSTVVREPSRGGGRPSASRPSGSRPAPPPASRPKYGATVTVQRGEGLYRIATNNGIQLADLAAWNNLSPPYNLYPGQRLRLYPQSGGRPSSGSVSAGSSVAGGTTAPRPSTPPPAPTASVDSGIRWRWPSDGPLLGRYLANEPTKQGIDIGGASGAPVRAAADGVVVYSGTGLVGYGELIIVKHNEQWLSAYGHNRKRLVNEGQLVKAGDQIAEMGRSGAARDMLHFEVRYNAKPVDPMLYLPAK

SEQ ID NO: 4659 - protein, 293 aa, Streptomyces sp.
  Derived Active Sequence
AENERAAPTVESSSAPGSPSEAATTATSAAETGGSQARESGESAADEQRTAVAVAAAPAIPARTASGVDSGRPRKPVLAVAGIVGAALIAVPLLLAGGVDEDKRPEGPKELAAGESDTVLDPGSAGAALDDYVAEKPTPTPTVEKPEPSAPVKAVAPPPAPKPEPTTSAPAKKVMPKPKAKPTPKPDWTASTVRAVSTLEVSQAWTTNRIRMVMQPDGNLVVYNEKNKPTWASMTFGENHRAIFQSDGNLVIHNGDDRPIWASDTWGNEGAELILREDGKVVIARSGKVLWST

SEQ ID NO: 4660 - protein, 97 aa, Streptomyces sp.
  Derived Active Sequence
ATDAAAAAPINRTNCNQNDYLEIHNNNGRDTLCFANAGEMPVAIYGVNWVESGNNSVTFQFQRNESDPRIETVTLGKWSQWNPGQPYLHKILWIKIH

SEQ ID NO: 4661 - protein, 84 aa, Streptomyces sp.
  Derived Active Sequence
IDHVTCNPGAGYLKIWSHLNGRDSVDCYANRGKTNFGGWWVDKISTGNNDVKYYDANGDVVKINRHKVISFPNRPPKVKAIEIL

SEQ ID NO: 4662 - protein, 93 aa, Pseudoxanthomonas sp.
  Derived Active Sequence
GDNDPQKKKAADADSSQPVSDTWITTKVKSSLLADSDVSGTKIEVDTVDGVVYLTGTVGSQAQADEAKRIAGEIDGVAKVDTSRLKVDAQASR

SEQ ID NO: 4663 - protein, 311 aa, Paenibacillus sp.
  Derived Active Sequence
SKKDKSQYPPPGELVDAGGYRLHIRKLGNGSPTILLESGSGESSLSWRDIPEKLSSFATVVSYDRAGYAWSEEANTPRTGENIVRELHTALKNADIRPPYILVGHSLGGMYSRLYAQTYRDEVAGLVLVDARPENDARRTNKIYAKERPKANPSPLISILLEKSGAFRLFPNFMLTGRVEYQDRKSFVNIVASSKYFRSVAEEGDLASTTEDAIRGQHLGNLPVRVIARGIQQDLTQFGISKRGNDQIEQSWQMGQREMLNISTNSKLIVAKKSEHMIIHDQPKLVIQVIRELITDTSHFQSTTSKAFTDD

SEQ ID NO: 4664 - protein, 429 aa, Stenotrophomonas sp.
  Derived Active Sequence
CEDDASPALRGSQCALMDVPLRHADPSGEHISLFLRRIPASADTTRRGEVWLLSGGPGESGASLYPLIQTYQRAFPGFDLVIPDHRGTGRSSRICPVQESPESPEGTGLAGTEWGPCIGAMYANLQRTSAFSITEAAQDLGILMSDADRSGPVLLYGVSYGTQLALRALQVNDLRVDGLILDGLVPPETTETFDLSRRTALVDQVGRDSMDERSLERYRTLLAVKDAGWQKEVPGGDVRRFFAALLSFPALRDRIPRIVQDLSAGDDRSLVATVKDWNVALAQLGQGGNNQPALPLVMLIAASENNARPELGMATVNEEAKDALFVSPIPDLLVNGSVPRYPRDAWFGTSPRTLPRTLVIQGTLDPNTAYAGAKEHAATLGRSGPVTFHTVDRGAHLLALVAPRCFVAAVDSFIEGAVISERCAEPTPE

SEQ ID NO: 4665 - protein, 239 aa, Paenibacillus sp.
  Derived Active Sequence
TQTVDGQPYHFGFKKSKGGELPSIAQEGFMQLIERQGGIFLGDTTKKELFLTFDNGYENGYTPKVLDVLKAKKVPAAFFVTGHFVKDQPDLMRRMASEGHIIGNHSWSHPDMSTISSTEIRSELDRVRNASAELTGQKEMKYVRPPRGIFSEKALASCREAGYTSVFWSVAYKDWDTNIQQGTDYAYRQVIGQLHPGAVILLHSVSKDNAEALGSIIDEARKQGYEFKSLDDLKVKHYH

SEQ ID NO: 4666 - protein, 552 aa, Pseudomonas sp.
  Derived Active Sequence
NITAQQSATILKAFSDASATDFRQFLGSVAKSELAKTANLGPAISAFLDNKTLSAEQQNEINRLLGIYARVKYGNAATETLRELVAIPTFQVEGVAQHDNPEFIKIADKIKGLAQAFNLNFRNIDNRVYEISLEGSGDEVVGIHAHADVVPVTPENWVLKDGTKLDPFKVTLIGDRMYGRGTEDDKNGIVVAMYAMKVIKEEKLPLARNFKLLVDTTEETSGDAIPYYFEHNPTPNYNLALDGGYPVVIAEKGYGTVMGNFPRRDGEGKGAEIISMTGGMATNQIPSASVAVLVTDKPAELAASLQKAGADYAKRNGGNFEVNAKVDGKDVKLTVTGVSAHSSEPESGVNPVARMLDFIHSIDGKVALKHNHITDAARYAADNWGLDYLGGKLGVGFSDAFMGPLTTSLTFVGMDDKTFKLAVNLRVPKGESPEALKAKIADKIGAWSKKTHVPATFTYSIAEPMYRNPEGEWVKALLAVSTENLGMEHKFGSSAGATSVHELPNGVQFGLARPEVKYTGHTDNEFKTVDQFLLDLQIVTEMMGRVGQLPKL

SEQ ID NO: 4667 - protein, 323 aa, Arthrobacter sp.
  Derived Active Sequence
VGEGPNYDGNGQITTSKLATYDQMVSFLKDQDARQSAMELEVIGQTVKGRDIHLVKYISDPAKPTILYLTQQHGNEQLTTEGALEFVKHLGTGKSADILDGVNILIVPMLNADGAMGDVNFPLDDYLAKGDRNMTRYNAEEVDLNRDHVAKIQPETQALHNNVMRKYNIDYMIDLHHQGTRSERDGELVSGSILYPTTPNANPAVVEKSKQLGAVVFHNVDSTGWGHLGKYVGGSAETISRNGIAVEYGIATLLFEMRGMSDHYLDGYALGLRSNGYLIKQTVTTLTATAAAIADGSIAGADTSFWDSLATQTSRPGGEADDE

SEQ ID NO: 4668 - protein, 563 aa, Paenibacillus sp.
  Derived Active Sequence
NNDGVTNLALDPTSSAQSDIISDAVYKITAQHSGKNLEVEGGSKDDGANVQQWTDNGKEQQKWRVVDVGDGYYKLISQSSGKTLDVAGGNTHDGANVQQWTDNGNAQQKWKIIDAGGGYYKLISQSSGKALDVVGGYTHDGANVQQWADNGSAQQRWRFTQIDTTADTTPPTAPTNLQSSSKTSTSVTLTWTTSKDNVGVTGYVIYNGTDLVDTSTTTSYTVTGLTANTSYNFTVKAKDAAGNVSEPSNVLKVTTSSDSSQNTGFYVKGTTLYDGKGNPFVMRGINHAYTWYKGQESVAIPAIAKTGANTIRIVLSDGQQWTKDDLSALQNLITLSEQNKLVVILEVHDGTGSDNAAVLNKIADYWIEMKSALIGKENTVILNIANEWFGTWDGNGWAQGYKSVIPKLRNAGIKNTIMVDAAGWGQYPKSIFDYGTQVFDADPLKNTMFSIHMYEYAGGNAETVKSNIDNVLNKNLAVIIGEFGIKHTNGDVDEATIMSYAQQKGVGYLGWSWKGNGSGLEYLDMSNDWGGSSYTEQGRAIIEGPNGIRATSKLSTVYSSGKQ

SEQ ID NO: 4669 - protein, 157 aa, Arthrobacter sp.
  Derived Active Sequence
TTSYCGLVWGSLAETDQRFSKTTVTNVRTGQHYCFDRMVLDLKGPATGYNVRYVPRVVQDGSGFTVPVRGGARLQVTLHAPSYDPYSGEPTYNPPANQAELSNVANYQTFRQVAWAGSYEGYTNIGLGVRARLPFRVFTLDGPGSNSRLVIDVAHFW

SEQ ID NO: 4670 - protein, 302 aa, Paenibacillus sp.
  Derived Active Sequence
EEHGTPVQKTIDLNEGFDNSNEASTEPLSLTSEEATSQATVTAIDHDANFSPSTLQFLKANTGLDGEQWDNIMKLVNKPEQDSLKWTEFYGYAEDIGDNRGYTIGIFGATTGGSNDTGPDGPDLFKAFDAASGASNPSIAGGLTRAGLKGKMSGSILKLSDSDSVIKKKINALQNNEAWREAMWRTFYDTYIEYSVQQAQKRGFNTALTIGSFVDTALNQGATGDSGSLEGILSRSGSSTNEKKFMTSFYAKRTLVVDTNDYNQPPNGKNRVKQWSSLLASGETDLKNADAAVIKATNWELK

SEQ ID NO: 4671 - protein, 482 aa, Arthrobacter sp.
  Derived Active Sequence
APASAAPTAQATRYVSEAGVTAHRAAVVNAAAVKAQVPSTANPLPGLDPAGDPANLSVLVNKSRPLNPATYAPADLVNARGSGQYLRAEAAAWLNGLFQGAADAGTGGLAVVSGYRSYAQQQQVYSSYVNLYGQAQADLISARPGYSEHQTGLAVDVGNANGSCGLSTCFGDTAAGMWVAANAYKYGFIVRYPNGYTNITGYSYEPWHLRYVGVDLATDMKRRGFATLEQYFSGNPSVHASITSGADLVAADAAGRLLRYPALPSGGYGVPVQIGSNWTGLKQAFVVDWDSDGVYDLLAQWNNGTLGLFKGWPGGAFSTQIVVGTGDWDAMTITVGKWSSDQGYPGVVGYFPDGGLRYYPNTSGRALTYRVDIGTGWAGLGLTMADWDADGANDILATTSSGLLLSYPGNGVGGFKGQPSIIGSGWGTMKALVPGFGLSGPGTRSITAQTVDGYLVDYGLGLGVWGPQRQVGNGWGSMKLFK

SEQ ID NO: 4672 - protein, 147 aa, Pseudomonas sp.
  Derived Active Sequence
VETLDGKVIEKILILKSSHQLQLINDGRPLKTYRISLGKRPKGPKLMEGDKRTPEGFYWVDWRKISDRFNLAMHISYPNISDSARARREGVEPGGMIMIHGTPDSEDTPEDLFHTLDWTDGCIAMRNMDMREVWNLVPDGTMIEIRP

SEQ ID NO: 4673 - protein, 154 aa, Arthrobacter sp.
  Derived Active Sequence
ATSYCGLAWGSQDKTAPEMSSASVTNVRTGQQPCFDRMVVDLNGPVKGYTVRYVPEIIQDGTGFTIPVYGNARLQVVVNAPSYDSNGVTYNPAAKAELSNVAGYQTFRQVVYANSFEGSTSIGLGVRARLPFRVFTLDGPGSGSRLIVDVAHFW

SEQ ID NO: 4674 - protein, 214 aa, Duganella sp.
  Derived Active Sequence
GELLLFSHEDFRGERVTIADGAASNFTDFGFNDRASSIVVRSGTWELCEHKDFGGQCAVFERGEYPNLRQFNNQFSSAREIQGGRRDRGNSGYGYGRDDRDYRDYRDERREERRDGRWMEDRREERRDYRERGDAVEMYNDVGFRGRHVVINNDMHTLRDVGFNDNANSLVINYGTWQVCEHADYGGQCRTYGPGRYPNLEDFIDRISSIRRVR

SEQ ID NO: 4675 - protein, 84 aa, Pseudomonas sp.
  Derived Active Sequence
RVDAGDVATSAGVSASLYSTFKDDKMVIPARDDASSFVASGGAIRGVYLESVLQKIRQENPGLNASDEELARAILTQQAQPAGH

SEQ ID NO: 4676 - protein, 632 aa, Pantoea sp.
  Derived Active Sequence
WSDLTVFGDSLSDGGNVGRFTYDGATHPLYDEIVAQSLGDNLRPSSQGGSNYAEGGAVAVPAINPLFNTQDQLDNYLAARGGRADPDGLYIHWIGGNDLAAAALAPLAARQIVDNSASAAASQVSRLLDAGAGTVIVPTVPNVGATPALLQAILQVLGPAAQPATAALFQSLSTTTTPDRAAREQAIETALGEAAGQISSIPLIRDAIAQQLIAAWQLLSQEAAALTDRYNQAEEQGLMAARGNIARVDINGLFNEVIDNPGLYGLTNTAGMACPPGVSAMDCTSSTTGFSQSQQYLFADRLHPSPAVHALIADYIQSVLNAPLQVAALSRAPSMLVGDAHNTLDGHLQQQRQQPANAGEFTVFGGYAGQQRDFRGDSLQDGDATSASGTVGVGYQLTDHWQAGAMLSTTSQRQDPSSRFDYRLRGNLVALWSQFNYLDRGWINADAHYADLDFDDIERQIRLGPATRTEKGNSDGKVLGMRLQTGWDLPLGSYVSTGPVASYALDYTQVDGYKEEGNSSTSMRFGDQTLHSQIGSVGWRIDSKDLLINPWAQVSYNHQFGDSDSAVTAGLKSTRTAFTRSSDASDDNWIDMAVGASVPLGTSVNAFAGVSAITGNSDMHQVTWNVGLNARF

SEQ ID NO: 4677 - protein, 743 aa, Collimonas sp.
  Derived Active Sequence
APAAADSATSPARPRIGLVLSGGGARGYAHLGVLQALEKMHIPIDYVAATSMGAVVGGLYASGLSVDELDRILTGTNLSDIAFDRNERADLPQSQREDDYQYPIGLSAGYGDGKLKLPAGLVQGNNLLALLQNWTPQLPANISFDKLPTPFRAVATDLGSGAEVVLSQGSLPRAIRASMAVPGLFAPLKLDGRTLVDGGLVRNLPVSLARSMGADIIIAVNIATDLQDPSTLESPTAVAQQMVTILIQQNVKHEIDTLKQQDVLIEPNLGDLSFADFSRGKDGVKAGYDAAERQSAKLAALALPPQQWKEYLAARSGGGPVLAQDTHIDAIEIRSNGQVPAAVVRRALDVKEGDFYNPVALNKDVARLATNGDFKSVTQELVTENGRNVLKVDADDKSWGPHFLLFGLGVSNNFDGRGDFNLQIGHRLPWLTESGLEWRNDAVLGSKQASLHTELRQPIWNTVGLYVAPYAEYGRRHIDLYTDEGAVTSKTVPVTAYRVDTTRVGVDLGIPIGRLGEFRAGVNYQWLTAAPAYNLPTEFANLIGVDTIFDKFRINQPVVRAQLTIDQLDDPLFPRKGYYLSAVSNIGLGGAANSYSDAQGKALWAGSRGRNTVNLALEAAGTYGNETNDASGNGGLGFSLGGFQHLSAYAPDQFNGNYLLYGRLTYLRDMPELNLPGLRNTVLGTSLEMGDIWQTREAFGTGSYKKSASVFLGGSSFLGPLYFGAAIAPRGVWNLYLQLGRVF

SEQ ID NO: 4678 - protein, 935 aa, Arthrobacter sp.
  Derived Active Sequence
FSALTLGVAAPAAAAVPPCPGTGGAMQIVAHTDDDLIFISPDFMRDIQSKRCVQTVYATAGEAGEGAAYWNSLEAGIRASYAKMAGVADAWTTSDAGVPGRPLTLQTLNAAPNVSVVFMRLPDGFPDGRGSSRYNGQSILKLWDGRLSSIRPVDGAAAFTKAQFQTTLNQLVANYQPTTFRTQDWTGNYQDPYDHSDHWATAKFAQLASRAYTGPHTASAYDAYVIDEYAQNVTGADLTNKVNTFVRFADFDKYLCDTPCPAPPYSDWLKRQYITAIEWTGNAAKSAGTTVSASSQKASGQSPEKARDGYAWGTPMDANREWVTNGGKAGSWIQYNFSPARTINAVTLFDRPILSDQVTGGNLAFPDGSTVPVGALPNNGSGLTVNFPARTVSSVRFNITSVSGSTTNIGLSEFEAHITADVVAPEVTATPPGGTYDIGQKVTLSANEPATIFYTLDGTTPTTASAKYATPITVNGPLTLKYFAVDAANNPSAVVTQSYSTGPDVTKPVVTANPLGGAYAPGTSITLTSNEANSVIKYTKDSSDPLTAGLVYSTPIVFAGPDPMTLKFFATDPAGNVSDVVTQTYNVPPDTRAPVVTANPTSRALASGATITLSADEPGASIYYTTDGSSPTATESATNFKYSAPLVMGTSQLTLKYIGVDAAGNTSPIGTQTYSVPAAGPPSSHDFNGDGKADVLSSDTAGNLYLYPGNGGGGLGPRQTALAAPAWSTITDTITPGDFNRDGKPDLLARAGDVLWFYPGDGAGSFGARVQVSTGWSTMSQLFSPGDFSGDGIPDLIARRSTGDLRLYEGNGSGGLRTPITIGTGWNVMNAILSTGDFNGDGTGDVLARRSDTGALWLYPGDGTRGWLAWKQISTGWDNRTSIAGPRDLDGDNKNDVIGRIGDTLWLYPGSGNGTLSNVPPTSLGTGWQAMKIIG

SEQ ID NO: 4679 - protein, 73 aa, Pseudomonas sp.
  Derived Active Sequence
AEDAPSADPEVTIRTEGDKTIQEYRQNGFLYAIKVTPKVGKPYFLVRADGSDGNFIRSDQPDMLIPAWKIFEW

SEQ ID NO: 4680 - protein, 320 aa, Pantoea sp.
  Derived Active Sequence
APMWPVPQPYPVPDDPTESLADLPPGSEYVALGDSYSAGYGLGDRTRLPTSACVQSARDYPHRLAARFGLDLTDVTCAGATSEDVTTGHQFTGVPPQIESLSSRTRLVTLTIGGNDADLFGTAASCLAISADGPVFSGRDAPSCESTLVQDGEDQLSVKIQSRVALGIADTLAAVQRAAPNAVVVFLGYPAIFPDAEHTPAKGCFRSALDLGTLAGSFPSDTFPFTDDDVAYLHGVQEELDAVSASAADAAGVRFVDVLERTEAHSACAPADERYVAGVSLTGSSDLRRIDLKAGALHPNGRGVAYLTDQMADAIRELAG

SEQ ID NO: 4681 - protein, 876 aa, Arthrobacter sp.
  Derived Active Sequence
QTSGPQPAPTSEAPGGGSSQGPQPAGNGPASPPVESTPRQGKLPDQQAPITGVELTPGVASQPAPDPAGKAEAQATKPKSMPGDAPDAESMKAAMRAAIPAGGAEMGQRSPRVVTNKQDKEAAAPARGKAVGAAVKATVPMAADTGHWRPTIGIQGQDVSAHQGNVDWQSQWSQGSRWAYVKASEGNYYLNENYTQQYNGSRNVGMVRGAYHFAIPNWSSGADQARYFVANGGGWSADGYTLPPVLDIEYNPYAGRTINGFYFGNTCYDMSKAQLGQWAADFGNTVKALTGRFPVIYSTTDWWNTCVGNSTFGSYPLWIASYWNNPTNSPGSLPASWNDYSMWQYSSTGPFEGDSNIFNGTFDELRTFARGVPTPSNPSIRSGADVLAVMPSGRLDNFPADGQGRISGPVTIGSGWGNALSVHVVDWNQDGVQDILAQWADGTLQVFRGTSGGGFSTPIQVGSGWQEMSLATGWWNSKDAFPGVIGQDGSGNLYRYQNASGGALGGGVLIGTGFSGHQFNLLDFDGDGSQDLVSRTGDGTMRLFRSNGLGSFLTEPARVIGNGWSAMTSVSSAAGFNGSGSQGLQARAANGDLYYYPAVNGSWGNRFLTGLGWNDALLIGGAPVNVEATLGVDEPDVLAIRQDGNLYRYAGSGSGGLTSPELIGKQWTGLKAGFLTDWNGDGALDILAQWSDGRLTLYPGFKGAGFGSPISLGTGWQDWTLTVGTWKKSDPRPSIVGYDPAGRLFQIGNPSGGALGTRTQIGTGWSGLDIVQMDFDKDSNADLLAKTASGDLMLYRSTGTGSFIPEAPAAIGTGWNVINSFGAIRGFAGAGSTGIIGRTTGGELRYYPVGQNRAWGPTSVIGSGWTGLKILSPASR

SEQ ID NO: 4682 - protein, 87 aa, Actinosynnema sp.
  Derived Active Sequence
IDQVACGNRTDFAKLDIRVGQNLGTNRCFANSGVVAVEVPNVYRASSGNNKLTVNYQSGSQYYTRTLTPGTHINFASVVRVYEVRIW

SEQ ID NO: 4683 - protein, 114 aa, Burkholderia sp.
  Derived Active Sequence
QSGLPDVKQQGDVSYVSGGVGLDESNAFQRAEHQWPLSIRFTGAGGEYLSGVHVSIMSHDGEVLKADTRGPYMLVRLAPGAYKVSANYNGKTEMRNVTVPAKGDAKLAFSWAAQ

SEQ ID NO: 4684 - protein, 78 aa, Streptomyces sp.
  Derived Active Sequence
SGFLSWEGPQNTGRAKELTRCGCSNIDPNFRAAYRFTYTGQTAAMYNQPDCAGTSHYTFRGNSESVQPFGWRSIFIHC

SEQ ID NO: 4685 - protein, 190 aa, Paenibacillus sp.
  Derived Active Sequence
ASLHTAKEGDTFFLLAQRYGVSVDELTKANPNIASNNIYAGLQIKVPGEKSVKAASDSKPQLLTEKAPANEGPTIEAWGKTFNYSKIVDVKASAYSAAADENGKWGAVDYYGNPLKLGTIAVDPNVIPMGTKVLVTGYSHPGLPDHSFVAVARDQGSAITGKRIDIFIPGNKSFVNDFGFQNVKLYVIDK

SEQ ID NO: 4686 - protein, 214 aa, Cellulosimicrobium sp.
  Derived Active Sequence
LATEPDLRVVTWDRGPDPAADAQVSTGESCAVEAQPLLPGQDPGALPPAPEVCFGSLEEALEFVSGGDVASSRLADVTAAEVEGLVSDLNASASSAAAGQRLAGTERATTAAASSLVLGVLWRDANYKGTSKVLYGSGTNGCYTGSTYGFPNLANLLMNNVVTSATTYAGCWVTLYDSYGYAGAKKNCTPHCATLGTFDNKASSVVYRPVGQLG

SEQ ID NO: 4687 - protein, 591 aa, Paenibacillus sp.
  Derived Active Sequence
ASTRQMEKLNRGAVAVKVPEGVLVSWRLLGTEADSVGFNLYRGTSKVNDAPITSRTNFLDKAGTTSSSYTVRAVVNGAEQAASPAVKVWNNNYLDVPIQQPAGGTTPDNVNYTYHANDASVGDLDGDGEYEIVLKWDPSNAKDNSQSGYTGNVFLDGYELDGTRKWRIDLGRNIRAGAHYTQFLVYDFDGDGKAEIVCKTADGTVDGAGVKIGDASADHRNTSGYILKGPEFLTVFSGDTGKALSTIDYVPPRGTVSNWGDNYGNRVDRFLAGVAYLDGVRPSIVMARGYYTRTVLVAYDWRNGNLSRRWTFDSNSSTNAGTAGQGNHSLSVADVDGDDKDEIVYGSLVVDDNGAKLANTGMGHGDALHVGDLDPDRSGYEVFKVNEDKNATYGAAMYDPRNGNILWGVNTGKDTGRGMSADIDPRTKGNEQWAPGIGLRSAKGQLITNTLPSSINFGIWWDGDLLRELLDHTSSSAGKIDKWNYMNSTTSNLLTATGTSSNNGTKGTPSLQADLFGDWREEVIWRKSDNSALRIYTTPYESEHRFYTLMHDPVYRLSVAWQNVAYNQPPHTGFYLGEGMSKPQQPNIYTP

SEQ ID NO: 4688 - protein, 323 aa, Paenibacillus sp.
  Derived Active Sequence
CDEEGVNVSLLDQADREIQAKFPKMHSFLLLRHGKLIWERYYNGHEVSSLNDLRSATKSFTSTLIGIAMARGDMPGPETAVHKLLPEYLPRRKETLLEQITIRHLLTMTSGLYWQTGKKLGEAFIHRFHRSKSWPSFALRLPVQEDQLGVFQYRSVDSHLLSVLLTHCCGIDAYTYALQYLFEPLGFGRSGWAQDPEGYTMGHIGLYLTSRDMAKFGDCCLHQGSWNGTELIPADWLHQATQRQVEGYPEFGDYGFQWWTGRLHGINYACAHGHGGQQIYLVPEANAVAVFTADSKVSRWKNPRTLLERYVLPAVSSLNLERS

SEQ ID NO: 4689 - protein, 35 aa, Pseudomonas sp.
  Derived Active Sequence
GGIPGQPDPDTPQPAEPTEPGEPTLPDEPPPAPVA

SEQ ID NO: 4690 - protein, 84 aa, Amycolatopsis sp.
  Derived Active Sequence
IDHIPCRDGENFLKIWSHLGGSSSVDCYANKGRISFGGWWIDRIYTGNNDLIYYDSNGSDVRINRWTDISFPNRPPKVRVIEIL

SEQ ID NO: 4691 - protein, 324 aa, Erwinia sp.
  Derived Active Sequence
QAPISSVGGNGSANSGGGLISQPPPIVSGSGRAAPAASGGRSENVVTQNGRIIYNRSYGNIPKGSYSGETYTVKRGDTLFYIAWITGNDFRDLAERNNVSAPYSLNVGQQLQVSNGSGGTLTGGNAITAADATAGGVPTQPTTAQMKSTTVARQPVITYSEDSGKPSEGKMLPSAGTNTVATTTAPVSAPTVSSTTNSSTPVGSWRWPTDGKIIDNFSASEGGNKGIDIAGSRGQPVVSTASGRVVYAGNALRGYGNLIIIKHNDDYLSAYAHNDTMLVREQQEVKAGQKIATMGSTGTSSVRLHFEIRYKGKSVNPLRYLPQR

SEQ ID NO: 4692 - protein, 313 aa, Collimonas sp.
  Derived Active Sequence
SCLDGNRMTGVNLSGAEFAADKLPGTIFKDYVYPDPADMRHFQSLGMNTFRLPFLWERIQPQLLGPLDEAEVHRIEETVAAARSLGTCVILDVHNYGEYRGKPIGSTEVPRAALADLWTRLLARFKDPENTAFGLMNEPSKLPVAEWAAVAQETLNILRKKGSRHLILVPGGSWSGAHSWFAKDNGVSNADAFRRFHDPADNYMIEVHQYADADFSGTSNTCVDPARLGAIMADIAVWANSTRRRLFLGEFGVPANQQCLQALAAIMDGMKGNSAWGGWTYWTSGKWLGNYPFSLQPDSNGDKPQMTILKTGM

SEQ ID NO: 4693 - protein, 159 aa, Pseudomonas sp.
  Derived Active Sequence
TYKLVNSGPEYAQVLAVQPVKQQIKTPREVCKDVTVTRQAPVKDQHQIAGTVVGALAGGLLGNQIGGGTGKKIATVAGAVGGGYAGNKVQEGMQERDTYTTTQTRCNTVNDISEKVVGYDVKYELNGKQGQVRMDRDPGSQIPVNKEGQLILGQNQPAQ

SEQ ID NO: 4694 - protein, 233 aa, Burkholderia sp.
  Derived Active Sequence
AALVGGCTMTPWTDSWQPTSTPQPSRQNQGGVLAGYYRVNPGDTLPSIAAGFGQRSQDVASWNHIAPTDMLTPGQVLRVAPPPGNTAITSPVPSSGQPSSSALPGATAAEPPALAWPAQGTVTSRFIPGKTRGITITSTGDKTVRAAAAGRVVYAGTGVAKYGPLVILKHESGLITAYGHNGKLLVNDGDAVAAGQAIAEMATDPDGRSSFDFEVRQDGKPVDPIGFLPRNGG

SEQ ID NO: 4695 - protein, 623 aa, Pseudomonas sp.
  Derived Active Sequence
NSMQWSSIRDGSLYLRTAQPDRLKIGWSPAWQSDANREQLYLLQPDGQLFKQLEIRADQAYGEQDIELPAAAGDYRLQIPGYSFRGFTVSHRGSTAAQFEPTKVHFSAEVHSGAELYFRVAAGEQAILAGKYYGGVSVLQASRLSDGAKVRLELKEHPAYGQFDQVALPPAEQDEVWRLSLGGSGKAAFWLDGTANLFAQEVQQLHSLDQPRGEAHLQLKAQILGTTPRLGIALPYAQPPQSTFGLLQAIGARAANFYSFVDVIEQEPEREIGFRRLYRERFGIDRDITLLAGTGRRAVLAADAQSFAGLDAWLADSVRLAGNGLHYLAFADEPNLNYPDYSSYALYFEQMLARAKANPEARAAGVRIAMPASSRLLDGPFRIGAGQRRGIDWARQLLERHGEDIDALAWHEWMVRDLLATRRYRDSVRAAAELVGLDAAGRPRKALLLSQTNISSGRDLSPYQQDTHYAGLWWASVVINASADGLLDMLNWFQAADEPDYPKGMLAQRSASQFSLKPVAVAQQFIARHWLAHVQALDNPAFEVDALAMSEAGRHSLLGVNKASRVQAVSLDGPGDLCQAAPLKLSLLGPDDQPRDATVECRDGRVHFELPGETLFALTWKAL

SEQ ID NO: 4696 - protein, 126 aa, Janthinobacterium sp.
  Derived Active Sequence
QTDSALPPVQKSGAVEYLSGGIGLDESTAIQSASPHWPLSLVFSVQAAGKAEFASDVKLEIRDAKGGVALETTASGPFLLAKLPPGSYSLHATLAGKALERKVQVKAGSSARVELVWPAGTNQGRP

SEQ ID NO: 4697 - protein, 524 aa, Erwinia sp.
  Derived Active Sequence
ANLSDIQVSNGNDRASITLSFGGQPVYGFFPLHNPERVVLDIRQSGVIKGLPLTFSGDNMVKRIRASTPKDKQSIRLVFELTQPGKTRAVTQRNGSTYNVVFTINGTRPAPRSAAVSSVSRPVPADNPFKGNAVTAVSNGNEVAVPGRTVRAVDEAIIVAIDAGHGGQDPGAIGANGLKEKNVTIAIARKLKALLNADPMFKGVMTRDGDYFISVMGRSDVARKQNANLLVSVHADAAPNRSASGASVWVLSNRRANSEMAGWLEQHEKQSELLGGAGDLLANSQADPYLSQAVLDLQFGHSQRVGYDVAVKVIAQLQRVGSLHKRRPEHASLGVLRSPDIPSLLVETGFISNPSEERLLGSSAYQQKIAESIYKGLRNYFLAHPLQSIPKEENRPLQSATAVDVQPNPAPVSTRYAGAVTRHVVKRGETLSGIADHYGVSMAMLRSMNTLKKDVVWVGQRLKVPASGAQSVSASRPQRHKVVRGDSLTAIAAHYGVSPKAIQQANNMKSQNVMLGQTLTIPTS

SEQ ID NO: 4698 - protein, 1070 aa, unknown
  environmental sample ## Derived Active Sequence
GQEMQEVAPSVSTSDSEVGTSESRSDVSGEMTETTTNASSEQASQGEETMMNSELVSASTDMSLFFDKKIRLRSVRSESAYLTWDGNGQFLMDALQSTMNQSFLINGTVEDGYTIQNSETSANLHVLSKEAFAQREEKIEQKWFFELLENGSYTVQTADGLYLSSNDKNELILSADAEDEAARWQVEVIEEPQKLPMEAPLTKIPLSEISIANGTYQIQSSGLSMFLSIGELDKTLRKQLVVSSEGYSLSSKFQITRQTDGWYTIKNKYSLLAADIAGGIGKPQVAVQQYQDNQSAAQRFRFLDAGNGDVVIESKLGTVIERTGGQSNESTPVQTYTFNNSAAQKWRVVSETVANEVNIADGIYNIAGSGINKNLSLANKSKSDRIGIVLDRNVSDQVQQQFDIKKEADGWYTITNNFSKKVLDISGGSAGSRVAVQQYFANKSDSQKFKFIDGGAGNVFILSKLGTVLDRTGGKTDNGTAIQTYRLNKTISQLWRLSAPQSPKTVDIKDGEYQIKGNSTTRVFSIGDLTTADAVLLRLRDSTYSKIDNFVINKQVDGWYQIKNKFSNKVLDIQSGSSKNGVQVQQYFANNSEAQKFRFIDAGNGEVYIQSMLGSVLERPGGGTSEGLAIKTNDLTNSAAQKWKIEKQASPNLVKPVNGQRYLLEAGNNTNAVLDINGGSTANGAVAHIWTEAVAPQQKFIPRDLGNGWYRLENEKSKKVLDVAGGSSSAKVAVQQYAWNGSDAQQFRFVDAGGGYVYVQSKLGSYLDMVGGASSNGTRIQTYSLNKSAAQKFKLQNISKANALRTTVTTNNQAKITVYNPNGGKVDSVRFPTWSREKGQDDIKWLIGKKNIDGSWTAEVNAAEFKNGGTFDTHVYVKSGGKESGVGTTSYKLDKPAPPAPPKPTAPPYYYSQWDGRWSGLTYGYYRFGPTGCVPTSMAMVLRGSYGVNVTPVDTANRIRSYGGFNVQYMGASSTDLVRGMNSYGRSVYAAKSEADLTDHLVQGYPVIMYVNVGIGHAIVAHGYSNGKTYISDPYNNQFYSGWVSISHLWSVPTKDPQDWNYGYPYFIIK

SEQ ID NO: 4699 - protein, 342 aa, Collimonas sp.
  Derived Active Sequence
LAACATQEPTTSGTQNAASTGKPILAPKPAAPAVTPQQAELKSLVALQDRLYDVAAPLLVNNAVLCRNNARNLLGFTAKTKFSYTAEFIDAATSLGLTDQLQVTGVLTGSGAAKVGLQRGDLLVAIQDKPVPTGADAERQTALMLGPLVNGRSNIKVTIARNGSNQTLNVPLTRACAFGIELGNTDNVISYADGRRVLISAGMMKFVRSDDELAYVIAKEMAHNTLTHPARQRLTATLSGVIDNLVRLRPDNAPLSGAAGVKPYPQQLDAAADKLALYMVARAGYKVDDASAFWQRLATQYPATVLNGYTAIHPATTYRIAAIEQAVSDIQAKQASGSTVLP

SEQ ID NO: 4700 - protein, 726 aa, Collimonas sp.
  Derived Active Sequence
AIVLENPLWHIVLDPGTLAIRVTPAGAAAVQVSDGVGSHRVAALQSTADQAGWQWDDGAYRIEAKLSERDLMLTVRANAAGALTLIRQPGSAIGRGLILPLAEGHYVARDNKVWNDFILQKMGRLNTTQDLSLPLWGMDHGKFSLHWLLTNPYNNQLDFSADGSGLALQASHTFTQLAPDTPMTLTLHLGDGDLLAGAKHYRAWLLAEGRFESLAEKTAKSPGAAKLIGASHAYLWGSGLIAAKDVRSWPAFLRILRSKNPLAIDLRRHFAPESRKALAEAGTNPARYQEKILVGAFNAGLNSLAREAWQTDAPDVNRLASRYGELRSEVARAFGAALNADAKDWGGGVSGATMEQLRKAGLARLWLGLGEGWEGGLWHPEAIAAGVKAGYLLAPYDSYETALPRGHNPDWATAHFGEKTYRDCAIVLDDGRFKTGFNGFGHYTNPFCMRPLMEARVRAVQEKAGFNSWFLDVTAAGMLFDDYRRRAAMTMAQNAYANAASTRWISEDRQLPAGSEDGNAVTAQGIFFAHGMQTPVIGWGDKEMQKDKKSPYYLGNYYPPEEPSNMFKAVPLKALYRSIHFDPAARLPLYQAVFHDSVITTHHWLFDNLKLTNVRRENELAQLLYNVPPLFHLSEGTLASRLPLMQRQDAFFRPLHEKLANQALTGFRWLSADRLLQQTGFADGTMQVANFSAEERSFNGRRFPPYSVTALTADGKTTVFVSEDGR

SEQ ID NO: 4701 - protein, 393 aa, Bacillus sp.
  Derived Active Sequence
RAGILCREFAIGFGPKIFSFKKNETVYTIRLLPVGGFVRMAGEDPEMIEVKPGYTVGLLFNKEDEVEKVIINQKEKYPDALIIEVETADLEHEMKITGYEQGKEDELAGFTVSQTSFFIVDGEEVQIAPYNRQFGSKPVWKRIKAIAAGPIMNFILAYVILVMLGFIQGVPSNQPELGKLTDNGRAAAAGLKEGDYIQSINGEKMRSWTDIVTAVKENPGKKIDVAVKRDGKSFHISVTPEAVKDENKKTIGRFGSYAPTEKGALAAIAYGATSTVDVTKAILTNLSKLVTGQFKLDMLSGPVGIYDMTDQVAKTGIINLFQFAAFLSINLGIVNLLPIPALDGGRLLFLFIEAIRGKPINRDKEAFVVFIGVAFLMLLMLVVTWNDIQRLFL

SEQ ID NO: 4702 - protein, 384 aa, Pedobacter sp.
  Derived Active Sequence
NKDVLVDLDIPQAGNYAQLYMPQATSNPIGMGISITDQDYQVPYAAHLGGSLAAQTDISVTFKVSPELVTQYNQKNNTTYQLLPEGSYALQTENAMIPKGAQGTGILKLVIKTKGFLQAFESYLLPVSVSAPSGVTLNKELSTTYFVITGSYAPGEVPREKVLSMGADAGDFLIDFNGDFIRKAPLTGDLILYKADAATGQFTAPPKTIGFGWNVMDKILSYGGNRLIARFGSGAGDINQYFLSQDGAFGAQRGVGQGWGGLSAIVPFKGLLLGIAANGDMTKFPLNGDGDFDYGNIKQIGTGWAGLAQIFSYQNSLITIENSGDMWQYPLTDDGVFGARKKIGTGWDMYTKVITAGTDLLALDANGDLWRYKFNPDGLWPLKK

SEQ ID NO: 4703 - protein, 102 aa, Paenibacillus sp.
  Derived Active Sequence
RDMLGLSMDMGGKKSGNLVQKARTKMMDAAFPGMGEITLNKEDTHKDQDHHSPTDKTAHNAHTAKNKEENMKLIKDFIRTSPDVKREVEQILKETHTAVPGL

SEQ ID NO: 4704 - protein, 634 aa, Serratia sp.
  Derived Active Sequence
YDQVYVFGDSLSDTGNNGRFTYDGNKHLLYDEVLAERIGAALVASDDGGYNYAAGGGVAVPALNPADNTQDQVQSYLGRVDGRADGDGLYIHWIGGNDLAAAALNPTTASDVAYNSAAAAAVQVRSLLNAGAGTVIVPTVPNIGSTPQLMELIIQQALTPVQGAAVQAAYATLNSLTTPDNVSRTQAIHQALTSAAAQASAIPQVQQAIAAQLIAAFDSLSAQAAQLTDFYNQSEDRLLAQGGGNVVRVDVNKLFAEAIANPAQFGFANTAGMACPAGVSSAVCSSATPGFDASQSYLFSDHFHPSPQAHLLIADYIQALLDGPAQVVALNQATAAMARDSRATLDSRFQQLRNGDNPQGSLGVFGGYAGQHYDYSANKAAGDGNATTHNLTVGVDYQLAEGWLIGALISGSNDDQQPSSRYEYKARGLLLSAFTALDLFEHGWVNADLHYATMDYDDIRRSMQLGPLTRTETGSTSGKQWGARLTAGYDFPITSYLTTGPMAQFAWDYSNVSGYSEDGNNSTSMRFNDQTYHSQIGALGWRLDSQFGLFNPYAEVSYQHQFGDDVYRAGGGLKSTQTSFTRDSAGQDKNWVDVTLGANMPLTDQVAAFAAVSQTGGLSSGEQFMYNVGVSARF

SEQ ID NO: 4705 - protein, 151 aa, Pseudomonas sp.
  Derived Active Sequence
AEPTLYGRYEYIALPEVGGQVLKAKMDTGALTASLSAKDIETFTRDGEEWVRFRLATKNASNKVYEHKIARISKIKTRSEEDEEDSEVIAPTKRPVVDLELCLGNVKRTVEVNLTDRSSFNYPLLIGAKALREFGAAVNPARRFTADKPDC

SEQ ID NO: 4706 - protein, 158 aa, Collimonas sp.
  Derived Active Sequence
ADSAKASYKAAEDAADATYKADKAKCDELSGNGKDVCLKQAKATREHTKQDAKAEYKNTPKAVAGARKSEADADYAVAKEKCDALAGNAKDVCVKQAKADQTNAVANANTQKDVSKAKADAREERADARYKVAMAKCDALAGAAKDDCVAAAKADAGK

SEQ ID NO: 4707 - protein, 385 aa, Pseudomonas sp.
  Derived Active Sequence
EPHPQVQNDAQQYQGDALKLLERLVNIDSGSGYEAGLNQVSDIAIAELKKLGASIEKVPNGAAGGNHVLATLKGTGKARILLMAHMDTVFKEGTAAERPFRIQDGRAYGPGVMDDKGGIVAGIYALKVLDNLKFKDYAQITFLLDASEETGSEIATDLIKKTAKAHDVTLNLEPGRPADGLVVWRKGSATALVEVKGKAAHAGVAPELGRNAAMEAAHQILQLGKLGDEAKKTTINFTVLKAGDRTNVIPDQATAKADVRAAVPEEFDRIEKDLARVSANKLIADTEVKTTLQRGLPPMPQTEQSDALVAMAQGIYGELGRKLTIEGSGGAADSSLSAGVGTPTLDGFGIVGGNIHTPEEYAEVESVAPRIYLLARMIMELSAKH

SEQ ID NO: 4708 - protein, 471 aa, Collimonas sp.
  Derived Active Sequence
VQNLPTLGDTSRESLSPLMERKLGEEVMHDIRRDPDYLNDAPLLEYLNNFGWTLVNARPEVRGEAGFDFFFFAVRDPVLNAFALPGGFIGVHSGLLLAAQSESELASVLAHEIGHVAQRHIARMVGSQKQDSMIALASMLLGALAMRGSGDAGAAVMMGGTGLAMQRQLNFSRDAEREADRIGLSILDSGGFDTSGMVAFFGRMQTASRNYSDVVPPYLLTHPLTTERIADIEARIREQRYRQRADSLDFQLIRARVRVLQDDTEQGRRDAQIVFDAQLQLNTKQQIVAAKYGMAFLAFKQGAYDKAEDLLQQAVAAALPAKQSLVLTDLGVEIMLASKREAEALKLVQQGQLQYPLSRGLAHQYARALIASKRLDDAIKYLREQARLYRQDADVQDLLAQAYSAQGKRALQHMALAESYVLTGSVPAALDQLRIARNSGDAGFYDQSMIDARERELQERWKEELAASKER

SEQ ID NO: 4709 - protein, 473 aa, Paenibacillus sp.
  Derived Active Sequence
ASIGERLTSPEAGWKRFDDKDPNIIYKGAWRDGNGDIYYNLSRKVTNRSGDTATLSFFGDKIRIITDSATGHSNKLNIEIDDVLESFPLNKGAGSQYLTYEKINLDNTWHKVVITTTDSLFSTIDAIDISENGFLGNPTVIEKIKVTSGEASADLNWGQVELATSYKIKRSTTSKGPYTTISNNSTGLEFNDSNLANDTTYYYIVEAYDKSGKLIHTTKECSVTPPYSSMEGMGGISPPVGTTATASSDDKNAIKALDRDFDSRWNAVTPIASLELKFPKPLHLNFVQLAAQVTPQTQVDYTIFGLKDGEWTQISPITTRAIDVSTQMRVLDRINITEGVYSSIKITANARSSWASIHEITLGIVSAIPVTPDSPGSETPTPDQTPNPEPSQPTGDRAILSVTLDTGLEKEFDLSMKEVNSFIAWYEGKQSGSGAASYAINKHNNNKGPFSNRKDYVIFNKILTFEVSEYSTK

SEQ ID NO: 4710 - protein, 226 aa, Paenibacillus sp.
  Derived Active Sequence
ASTSGSHKSNQRGTATVPAPVEKDTSVQAIEEAAWKKHKLPKTLEEAMQMNRASVLLLSVPESDTEYRLDNDKPSITTEDQAEQDSLLDCSITSIHIAEGRPRPKQRVVLSEQDIDQAFDTAKELNLNVIHDGSATSDEASDDHIASPQYGSIPFHLPAQADRGEVSVVFEKPFIDTQYVITANASILGVMVSVTQRQRYSAVLTVERIHSGPLCEGLVLWIAMGQ

SEQ ID NO: 4711 - protein, 228 aa, Serratia sp.
  Derived Active Sequence
NTDTLLQSGAQAYQAATLSDSDVKALSDKSCAEMDSKEQIAPASSDYTKRLNKIAAALGDNINGTPANYKVYVTKDVNAWAMANGCIRVYSGLMDMMDDNEVEGVLGHEMGHVALGHTRKAMQVAYGTVALRTAASSAGGVAASLSQSQLADLGEKLVNAQFSQKQESEADDYSFDLLKKRGINPEGLATSFDKLAKLDGGHESSMFDSHPTSEARAKHIRDRIAAGK

SEQ ID NO: 4712 - protein, 309 aa, Bacillus sp.
  Derived Active Sequence
SEEKETAYIDVAAATLWTAPNILREVDAPSATNPVDMKKWTTSMDLKQKQQLSSDGMLETQALYGNKVTVLERQGDWVKVAVDGQPTSRNELGYPGWMPNKQLTYSKRYDQYAKDPFVMVTAPTTYLYHSPYLKKKGIEVSYNTRLPLLTKSKRAYKVLKPNGKTAWISAKAGKIYASQKDIPVPTGTELVESGKAFLNLPYLWAGMSGFGFDCSGFTFTMYQSHGITIPRDSGPQSRAGKPVDMNNLQPGDLLFFAYNQGKGSVHHVAMYAGDGMMIHSPNSERTVEIIPLNTKGYIEEYAGARRYLP

SEQ ID NO: 4713 - protein, 592 aa, Burkholderia sp.
  Derived Active Sequence
DTVAANTSTPLAATPPMGFNNWARFQCTAQAPTDGSARANYSFQHFMLDQAEAMRATGLVASGYTLLWVDDCWMSRIGSGQIQGAARWGGSQQPGFDPDLGAYVSAVHAKGMLAALYNTSGAKTCQGVAAGEQGHQLQDAQTYVAWGVDALKLDNCGAIDNATPQQLFKQMADALGQASAGSARKILFNESAPAGYGPTGSAKYATLDWVRPLGQMWRTGPDIRTTSMTAGGQAASDPWDYYNANAYQEGVYQSYNETIALSRYVSPGNWNDPDQLLIGDNGLTPAEERSQMALWSAMAAPLILSTDVRKFAANPADPRWQQSLATLNNAEVVAVDQDRLGIGGYRVSRDDPSSSAGIEVVAKPLADHALAVVVLNKGAASASPTLSFSNLGYRNGADGTPCTLAVRDLWAHSGSQLAAQVPLTIGAHDNAMLKLSGTCGGWAPTGEIETVGDWGATPLCIAAGSAAPGAALALANCDAGPKQRWSRKADRTVELAGTGLCLSSTAPGATLGGAAGQWATLASCNAQDTKQQFSYRRNGQLAAAADGTCLDIYRGVVDGTLGKPGTPLDLYACTANQVNQIWAAPHADVLND

SEQ ID NO: 4714 - protein, 361 aa, Collimonas sp.
  Derived Active Sequence
QTLPPPTVAAKSWLLLDTTSNQVVASQDPDMRIEPASLAKIMTAYVVFDALKDKKITLDQMVNVSVRAWKVDPSSSKMFIEPNTPVSINDLLYGLMVVSGNDAAVALAEAVAGTEDSFVALMNHEAERMGMKSTHFGNPHGLPSADTYSTARDLATLAAHVIVDFPEFYKIDSTKKYTYNKITQPNRNRLLWLDPTVDGMKTGHTSSAGYSIIASAKRPNAGGDRRLLAVVIGTNSDGTRTQEAQKLLNWGFQNFDAVKLYAKGQAIDTPQVWKGAKSQIKIGFTHDVYVTVPKGIADKIKPVLERTDPLIAPIQQNAKVGTVKVNADGKTIAEFPVVALEDVAQATIFGRAWDSIRLLFK

SEQ ID NO: 4715 - protein, 355 aa, Salinibacillus sp.
  Derived Active Sequence
AINVSAKSAIVIDGTSGRVLFAKGEHEKRRIASITKIMTAVLAIESGKMEETVTVSANAVRTEGSAIYLTEGQKVKLKDLVYGLMLRSGNDAAVAIAEYVGGSLDGFVYMMNQKAEQIGMENTRFQNPHGLDDHENHYSTAYDMAVLTKYAMKLKDYQTISGTKIYKAETMESVWKNKNKLLTMLYPYSTGGKTGYTKLAKRTLVSTASKDGVNLIAVTINDPDDWDDHMNMFNYVFDHYQTYLIAKKGDIPKLKGTFYESKAFIKRDITYLLTEEEKEDVKINTTLLKPKKAWEKDVSKIPDIVGHMKVMFNDETIAKVPIYYENERNQKPKKKFFETFQSIFLNAAGGAKWSI

SEQ ID NO: 4716 - protein, 447 aa, Pseudomonas sp.
  Derived Active Sequence
VELPDFTQLVEQASPAVVNISTTQKLPDRKVNQQMPDLEGLPPMLREFFERGMPPQSRSPRDRQREATSLGSGFIISSDGYILTNNHVIADADEILVRLADRSEMKAKLVGTDPRSDVALLKIEGKDLPVLKLGKSQDLKAGQWVVAIGSPFGFDHTVTQGIVSAVGRSLPNENYVPFIQTDVPINPGNSGGPLFNLNGEVVGINSQIYTRSGGFMGVSFAIPIDVAMDVSNQLKSGGKVSRGWLGVVIQEVSKDLAESFGLEKPAGALVAQIQDDGPAAKGGLQVGDVILSMNGQPIVMSADLPHLVGALKAGAKADLEVIRDGKRKNVELTVGAIPEEGKEMGAEPKSSVERSSNRLGVSVVELTDEQKKTYDLKGGVVIKEVQDGPAALIGLQPGDVITHLNNQAIGSTKEFADIAKALPKNRSVSMRVLRQGRASFITFKLAE

SEQ ID NO: 4717 - protein, 466 aa, Pseudomonas sp.
  Derived Active Sequence
HGYVESPKSRAFMCSATGGNLNRDCGPVTYEPQSVEYSPSVQHHYPKDYCSGDFTKCGPANGTIPAGGITSFSQLNEQTATRWQKTTIKPGMNEFTWHYSAGHASAYYQFYITKKDWNPNQPLTRDSFEMTPLLNENAGGVRPPAGGKTKHKVNIPADRSGYHVILATWKIADTAATFYQAIDVNIDNDGAPIPDWKTLGAVQPEQLRVGDKVSTRVFTNAGEQQNRQTRLSIETAEQAQANTWPFLLAQQVNKANAGYVMGELNANNEVVPNYGKNTIYAKNNSDVVRVEIQKEQPSIPGELKLSGLQAEYSLKDSATDLHFNAIAQGGKYTIASTVFNGKGESIAHQQAEAGNNTPHFSIPLRNVSEGEYDVVVVAKPEKGEQLQQSQRITLKAEEVGGGGDYDFVFPKGLTGYKAGTKVLAKDGNVYECKPFPYSGYCIQWNAGATQFEPGVGSNWKDAWIRK

SEQ ID NO: 4718 - protein, 512 aa, Salinibacillus sp.
  Derived Active Sequence
DQSIKYDHTYQTPSYIIEKSQPSWQPAQNLTQKEALFSYLDKQQTHFKLKGNANSHFRISKTIKDSKTKQTFFKLEEVYKGIPVYGFGQAVAMKENKQVKSFFGKVHPQINDISVTPSVSKKKAIHTARRALEASIGKIEYVDGEPKAELYIYPHEGAYDLAYLVRLSTSEPEPGYWHYFINAKSGKVIDSFNAIHEAAGTGIGVSGEEKSFEVTEQNGRYYLADETRGKGINTFDAKNLNETLFTLLSQLIGYTGSEVVSGTSVFHDPAAVDAHANAQTVYDYYSRTFGRHSFDQNGARITSTVHVGTQWNNAAWNGVQMVYGDGDGARFKPLSGSLDIVAHEMTHAVTQYSAGLLYQGEPGALNESVSDIMAAMTDRDDWEIGEDVYTPDVRGDALRSLEDPSKQGNPDHYSNRYTGTEDYGGVHINSSIHNKAAYLLAEGGVHHDVRVEGIGREACEQIYYRALTYYVTPSSDFSMMKQAAIEAANDLYGEDSKQSASVEKAYDAVGIQ

SEQ ID NO: 4719 - protein, 351 aa, Janthinobacterium sp.
  Derived Active Sequence
QSYVYKNLSLPDVDGVARAINNQGQIVGSSYFEGAGNHATLWSGSTTTDLGSLGPSSSAARAINGSGQTVGYSLYSSTSITATSWNAASGSPLALSPGTQSNARAINNAGQIAGYTTAAPGSSRATIWNGNSTTYLPTLGGNDYALGINNHGVVVGDAYFTGSEASHAMVWDGGGVRGLDALGGVGSSAAAVNDNGAIVGSSQLANGTWQATLWNGDTISNLGAPGYDGGQAWAINNRNQVVGYTYTGNNNDSSTWRATLWDGGRMVDLTSFVDSDSRAAGWVLTQAYGINDKGWIVGEATNMQTFSRHAFLLSVSAVPEPSAYASLLMGLACMGVLYGRRVGSTKKNPPA

SEQ ID NO: 4720 - protein, 363 aa, Curtobacterium sp.
  Derived Active Sequence
EPAAASAVWVGSAPAGTKILPGDQVTSPNGQFKLIMQGDGNLVEYGIGNRVLWASNTAGNSGAIAVVGKNRALDITKNGKRVARWASAGTVNSTALKVRADGTMALLAGKTVVVSWNGYQDRVPSGNTILGGTVLRSDTSNTRILNMRTDGNLVQKVSGRVVWQSRTGGHPGAWAELQAKGNFVIWTRDASRKKVALWSSRTSTAGSGNLLVQVDGNVVLYGAKDTRVWSSRPVTGLAWPVNGTKITGRYGDDRGAGHVPRYHQGTDAPVPVGTAVYGSGTGTVTKTIANDAAYGNYIVVTYGMTAVLVAHLSKIEVKQGQIVKLGTEIAKSGNTGQSTGPHVHVETRRNGTLVDPLKNMHFR

SEQ ID NO: 4721 - protein, 458 aa, Salinibacillus sp.
  Derived Active Sequence
ATIKVKSGDSLWKLAQNYNTSVAAITSANHLSTTVLSIGQTLTIPGSNSGTSSSSSGSTAKKSGNSVYTVKSGDSLWLIANEFKMSVQELKKLNGLSSDMIRAGQKLKVSGKVSSNSSSGTSSSSKSSKSSKSSSSSSASTGTYKVQLGDSLWKIANKVNMSIAELKVLNNLKSDTIYVNQVLKTKSAGSNSSSKNNSSKSNQSASATTKYTVKSGDSLWKIANKYNLTVQQIRNSNNLKSDVLYVGQVLKLTGKSSSSTSTTPSSSNSSSGTTTTTYTVKSGDSLWVIAQKFNVTAQQIREKNNLKNDVLQIGQKLTITGKASSSNSSSGSSGSTISTSAKINKMIAAAKDHLGVPYRWGGTTPAGFDCSGFIYYALNKVTSVSRLTAAGYWNTMKPVSQPAVGDFVFFSTYKAGPSHVGIYLGNGEFINANDSGVVISNMNNSYWKQRYLGAKRYF

SEQ ID NO: 4722 - protein, 987 aa, Arthrobacter sp.
  Derived Active Sequence
DQQRQVVGTGLTKPAGTVVDPVGKVWVSDSVAGFCRMSDPVNGQPGTVEKDTCLGGSLAGSQQGPKVPGVATILDPTPSSAGSGDETAFIPDSSVGSSHVVRAVWSPALDLFEYSSTLTILDGDVRPNAVSDGPDGNIYLSFANARSIIKIVDPTIKHPSIESIASVTTKALGLVAAGWDSNGHVSVYVLETTGMRAFSAPDDGDMTNYVPLASYNVGVASSIFYDYDAHIIYTGTSSGATAADAGKDKVSRLNLSTGTVDNSWALGFSKISGLGMRAGQLLVLDDAGQLNNPPATGQGKMSLLGGVVAQITSGPTLANGSQSPNPAFTNDTTPTFGVSADPSGSALECSVGGAWTDCTSGTYTSAVLANGPQTFSVRPAPGGVPVSRTFTVDTVAPAAPVFTAPNSGQVVNGKPVLGATFEPGTTLSCSVDSTADADFKACVPGDTFTLTTEGAHTLRIRSTDPAGNVGPAAALTVTVDLTAPQVAITAPASGATVGAGYQFQFASTSPDIAGFRCRLGTDAFTECTSPKVYADIANGPNRFEVEARDKAGNTTVAGVNFTVFVADTTPPTVTADPVAGTYGPSSKIALTASEADAKIYYTEDGSTPTTASTLYTAPIAMGSKTLKYIAVDAANNASAPQTQVYVLDNVAPAVTANPTGGNLALGQSVTLTTESGAKIYYTTDNTTPTVASQVATTTVTITPAATTTVKYFAVDAAGNQSAVASQTYTLPAAPANTWKDYNSDAKNDVLARDSAGTLWLYPGNGTGGWLGKVNTGTAWNNYNLIVPTRDFSGDGRSDVLARDGAGQLWLFKGNGTGGWQPAVSVGSGWSGMTAIVAPGDFNGDGKSDVLARDAAGVLWLYKGDGLGKFTAGSTQVGAGWNVMNTLFSTGDFNGDAKTDVIARDTSGGLWLYPGNGTGGWGTRTQIGSGWGGMTALLGPGDFNGNGKSDVLARDASGNLWIYPGNGTGGWLAWSQVGNGWQGFTSLP

SEQ ID NO: 4723 - protein, 66 aa, Pseudomonas sp.
  Derived Active Sequence
DRPGAGWVTIEKAIETAKTKAGYIEIYKIEADNNGYWEGEGRKSDGVVYEFRIDGASGNVVRDQKD

SEQ ID NO: 4724 - protein, 57 aa, Paenibacillus sp.
  Derived Active Sequence
ENSQNNMGTNDNGRTQMLTTNNNDDDNDNDNWGWLGLLGLVGLAGLKRREPENHKKR

SEQ ID NO: 4725 - protein, 48 aa, Pantoea sp.
  Derived Active Sequence
SNADCAQQIRSHSSEAASGYIYVNRLDAPQKSPVNAPARAAEKSSAHW

SEQ ID NO: 4726 - protein, 95 aa, Bacillus sp.
  Derived Active Sequence
AKKALPVTLHVENADGSPAAGVTVTVMKAAESDHQPNIDRGEIIGKTDHHGEMTWKSGAKGTYAVVFEKDGVPETRNISLAESDKHTVISITLKH

SEQ ID NO: 4727 - protein, 346 aa, Serratia sp.
  Derived Active Sequence
EWPAWQQYKQFYISDEGRVIDPSSPNRITTSEGQSYGLFFALVANDRPTFDKLLEWTENNLAAGDLSAHLPAWLWGEDDKKRWTVLDTNTASDADLWIAYNLLEAGRLWKSRRYQTLGTLLLQRIGREEVADIPGLGLMLLPGKIGFVAQDRWRLNPSYLPPQLLARFAALNGPWRAMQKTNQRLLLETAPHGFSPDWVVWQAGKGWQPDTVKPDVGSYDAIRVYLWVGMLADDDEHKAALVKQLLPMAQLTAQQGVPPEKTDTASGKTSGDGPVGFSAVMLPMLANQTAALDVQRQRINQHPPGDDAYFSASLTLFGQGWDQQRYRFNRQGELQPAWGGQCVTSK

SEQ ID NO: 4728 - protein, 187 aa, Rhodococcus sp.
  Derived Active Sequence
TPTALADKFASTVTDDGWTLDLAATKLSANPVPNLATTAFTREGFVSAKVTGTIGGQGDSAVKTGYVEQGLQIGCQIDVSSGLGLGLGFSLGPSVGVSISGVPSANVGVNASVNPSIQSTIAPGTITTIPLGKKDLESSKASITAENVHVKVDACMGPVTIRSYAQLSVSTATSDNTLFVYSDPTWL

SEQ ID NO: 4729 - protein, 66 aa, Pantoea sp.
  Derived Active Sequence
ASLVSSEQAQGLQPMNQTISIGGRNGDQTHIRQVLSEKADAQGASHYRIIENNQDNTWHVTAELYK

SEQ ID NO: 4730 - protein, 108 aa, Erwinia sp.
  Derived Active Sequence
ADGYDRCPDGYYCMFSGLDGTGDMIALREDTPDLAALGMNDRAKSDWNRTASTIYLWSDAQYTGCTAVTSAGPTGKGNFFPTYQDFFSSVQFDGPGGPSCGTPPGEGR

SEQ ID NO: 4731 - protein, 78 aa, Herbidospora sp.
  Derived Active Sequence
SVYVAYEGPGFSGRSVALSACGINNIPFGGSYKWYGTGQSGRMYNLPNAQGVAHFTLDSNRNAEQITPVGWKSVFIVC

SEQ ID NO: 4732 - protein, 294 aa, Brevibacillus sp.
  Derived Active Sequence
SSTDVQERLRDLARENEAGTLNEAWNTNFKPSDEQQFSYSPTEGIVFLTPPKNVIGERRISQYKVNNAWATLEGSPTEVSGTPLYAGKNVLDNSKGTSDQELLTPEFNYTYTESTSNTTTHGLKLGVKTTATMKFPIAQGSMEASTEYNFQDSSTDTTTKTVSYKSPSQKIKVPAGKTFRVLAYLNTGSISGEANLYANVGGIAWGVLPGYPNGGGVNIGAVLTKCQQKGWGDFRNFQPSGRDVIVKGQGTFKSNYGTDFILKIEDITDSKLRNNNGSGTVVQEIKVPLIRTEI

SEQ ID NO: 4733 - protein, 456 aa, Pseudomonas sp.
  Derived Active Sequence
DDLPSLGDASSAIVSPQQEYQLGRAWLAMLRSQVQQLSDPQLKDYVESSVYKLVETSQVSDRRLEFILINSPELNAFAAPGGIVGVNGGLFLNAQTEGEYASVLAHELAHLSQRHFARGVEASQRMQVPMMAALLAGIVIAAAGAGDAGIATIAGTQAAAIQEQRRFSRQNEQEADRIGIINLEKAGYDPRSMPNMFERLMRQYRYDAKPPEFLLTHPVTESRIADTRNRAEQAKQGGIEDSMRYQLIRARVQLIYEETPGLGAKRFRAQLDENPKNDVARYGLAIAQIKGGQLNEARENLKLLLTTAPNEIIYNLAQVDLDITNNRLPDAQTRVDRLLTQFPGNYPLNQVRVDLLLKQNRTADAEKALENLLKSRPDDPDVWYMVAETRGLSGNIIGLHQARAEYFALVGDYRQAIQQLDFAKRKAGGNFPLSSRIDARQRELMEQERMIKDMMG

SEQ ID NO: 4734 - protein, 327 aa, Streptomyces sp.
  Derived Active Sequence
TTADPAPAPATLSVASADKLAGTLLSELGDEAAGTYYDAKERKLVVNVVDEDAAEGVRERGAVARVVEHSLAELKSARATLKAEATIPGTSWSVDPVTNKVVVTADSTVKGAKLEKLNKVVDGLDGRAAVERVAGEFKPFAAGGDAIHSGGGRCSLGFNVVKGGEPYFITAGHCGEQGSSWSDSAGGAAIGTMEESSFPGNDYALVKYASGADHPSVVNLYNGSTQEITQAGDATVGQQVQRSGSTTQVHDGEVTGLNETVNYQEGSVSGLIKTTVCAEPGDSGGSLFAGSTALGLTSGGSGDCSSGGTTFFQPVPEALSAFGASIG

SEQ ID NO: 4735 - protein, 84 aa, Streptomyces sp.
  Derived Active Sequence
IDHVTCDPDRGYLKIWSHLNGRDSVDCYANRGKTNFGNWWVDKISTGNNVVKYYDANGDVVKIDRNKAISYPNRPPKVKAIEIL

SEQ ID NO: 4736 - protein, 117 aa, Streptomyces sp.
  Derived Active Sequence
ATHAAKALQIASSKKGSPYRYGATGPRSFDCSGLTLYSYKKAGKKLPRTAAQQHNRTKRIAASNRRKGDLVFFHSGGSVYHVGIYAGGGKIWHSPKSGAVVRLEKIWTGSVRYGRVN

SEQ ID NO: 4737 - protein, 56 aa, Dactylosporangium sp.
  Derived Active Sequence
ATVDTSATYVLVNRNSGKALDVYNFSTADGARITQWTRSDANNQQWQFVDSGGGYY

SEQ ID NO: 4738 - protein, 383 aa, Duganella sp.
  Derived Active Sequence
ASTCDRYASYPVKGGTYTVITNFWNDKASGSQCVNVNQDNGEWSVSSAPSSPDSTPAAYPAIYKGCHWASCTKDSGLPLQAKAITYAPTRWRVTPGAGGDWDIAYDIWFSSGREAPPSGQPDGAEIMIWINHSGSVQPAGSKTANVNINGMNWDVWTAWNNPSGWPRWNIVSYVATSPVNAVNFDLVPFFRDSVGRKAVDNNWYLLDVEAGTELWRNGAGFASGDFDVQFHTDPVKGIDPNKWYSVVNKNSGSCVDDADFSTSNGAVVHQWACDSRGAANQQWKFTPTDSGNYRVSTQQAPGLAWDVAGWGTANGSLVQLWTYGGGSNQQWQAVDLGDGYYKFVGRGSGKCLDVPAASTSNGVQLQVYDCNGTPAQSFKLIAQ

SEQ ID NO: 4739 - protein, 110 aa, Pantoea sp.
  Derived Active Sequence
EDTCAKQPSDGALFQCTVQQKKLAEDELNKEYQTAKKRIVQMYGTQKKLADDYVATLVDTQRSWLRYRDGQCKLEAFAAEEGSNANAVATNLCVIRIDKERTAILKQLPY

SEQ ID NO: 4740 - protein, 119 aa, Paenibacillus sp.
  Derived Active Sequence
EEESRQRSKRPYPVQVEPEVRERIDSTREMPHKDIDVEEHHAEEQHKVPDIQTDKKVEKDRENIKDAYGDQDYRAALRGFARKDEEKDRRSQISNGEKETHKSEDEQYREALRSMNQKK

SEQ ID NO: 4741 - protein, 54 aa, Pseudomonas sp.
  Derived Active Sequence
ADQSNQYRAHYVQHQAPQWAVMSSTSENPGMAQVADAPEAVVLPANPRPESWVF

SEQ ID NO: 4742 - protein, 229 aa, Serratia sp.
  Derived Active Sequence
AENIEAKAIGPKHGATLIPKARQVICEQDGGYNHPDDGSNIPNAACRNAFLYKAETIPIWERRQMFTEWPAYSQNLQGTQHPSDKVPDGQLCSAGIAKFEGIDQPHADWYVSSVSVKDGQATLYFDATQVHEPSKWTVSLAKPSFNAATDKLKWSDLTPLEVTKVTVPPPAKGNHVKYAGVYQIEVKIPADRADGKQTLLYVQWERQDPARETFFSCSDVRFNGESAAK

SEQ ID NO: 4743 - protein, 248 aa, Duganella sp.
  Derived Active Sequence
QITFYENDGWRGRTFTANQQVRDFTRNGFNDRASSVVVDRGQWEVCDDANFRGNCMVLRRGSYESLRGMGMNDRISSVRPVGKRNSYANEAPAPLPQPTYEYRRRPSERLVEVPVTSVRAVVGTPEQRCWVESQQVAEPARNGTNVGGVIAGALIGGILGHQVGGGTGRDVATAGGAVAGAAIGNNMANNSGQQSYARDVRRCENVSNPKPEYWDVTYNYRGQEHRVQMSTPPGQSIAVNSNTGEPRM

SEQ ID NO: 4744 - protein, 439 aa, Actinosporangium sp.
  Derived Active Sequence
ATADDIRLNEVVTTGSTNDSIELHNKGAGTVDLSGWILKDSNSSSKYTIGSGTTLAPGGFRAFDVHDAFGLGSSDKARLYLADGSTLVDSFSWSSHSSASWSRCPDGSGSFGQAATLTLGAANNCGGGGGGGVTPSAWPGSSTVTTADASNVFGSDLSGLHQEGGVLWAAQNSGKLWRLVSNGSGGWQPDTASGWSAGKTLRFTGGSGAPDSEGVTVTGAGSGSAGGVFVASERNGDASGTSRLSVLRYDVTGTNSTLSATREWNLTSNLPSVGSNAGFEAITWIPDSALTSAGFKDESTGAAYDPSRYTAHTGGVFFVGVEGTGSLYGYVLTDTGAYTRVASLSSGMAGVMELQWEPQTSRLWLVCDDNCSGQHRTMKIDTTGAFATTAAYNRPGGMSNLNNEGFALAGECVAGAKSVVWSDDGNTGGHALRAGTIGC

SEQ ID NO: 4745 - protein, 542 aa, Burkholderia sp.
  Derived Active Sequence
QSKTGNPQAENLRESLTRGVAKPAAGGEAAPSSTGAVSVTLANPAYRVKKTASTPEATARDFLATQARQLGLDATALAGLELVSQRQDPDFTVVRLRQVAAGLPVYGSEIAVTIGKDGSVLYVASNAIGGVAPKASKTQAVDQQQALDRARSYLGIGELRNAEAQLVAFRDAAGTHTAWKVRGRPDGGPKGDWELLIDATSGEVLRAEDKAFYATDGSGYVFRPDPLSSTKSSYGSTGYKDNNDADSAQLTAARVRVTLKDLKQSGASYSLSGPFASCIDFDAPRDNACPVQPSPAFEFTRGNLYFEAVNAYYHIDTFLRYVNQTLGIKALPYQYTGGVQYDPHGESGDDNSSYSSSSGRLTFGQGGVDDAEDADVVIHELGHGIHDWVTNGGLSQSEGLSEGVGDYLAAGYSRDFNQWSPSDAQYNWVYNWDGHNEFWPGRVTNYNVGRTYAQIRSSEIHTAGQYWASCNLVARDAIGGQAMDKAFLKGLSMTNGSTNQKAAAQAVITAASALGYSSTQINAIANAYNKSCTYAVTVPQKS

SEQ ID NO: 4746 - protein, 65 aa, Pantoea sp.
  Derived Active Sequence
AQLVTGDQTQNLQPAGTVTISGTAGSPMDYRAELSQKADEQGASAYKVIEARTGDNYHITAQLYK

SEQ ID NO: 4747 - protein, 538 aa, Thalassobacter sp.
  Derived Active Sequence
DMNPTEERLFLLLKSKPSFMRAMPAGREMRELVFKGRAVPGPLEWGESPTEIGIKPIGLVTHVARNCSNDTVGVISDTFKASYEQTQSWEVTVGTELTNSVEVTASLPGVVETTAGTAVTLKFEGSKGGETKSTKSHDAGYSIPVKPGRELDVQFQITEQVIEGTPFSIEMELLGKVEITHPPQGNWVRYRGSVPAKAVSAGKEWNAAGTKRRDLWVCRAAGSPHIGKVIGRRCNYGYGGQEKTTTNFDVLVVAGLETNWVGKSQFESGDDYDEDIVAEGKAEVFYGGQESRPTKRYKGWTFVCRAKHKGDFHPGKVVTNDCMIGYGGKELQKGRYEVLMRGKEVGDVTPVDLQDHLPDAAERTFVVEGVFEDARSFGATTVFGTSRPVNRTVCPGYVPPQNDTSIRDVEVRTSEPVTYSGDSVAIPAAYNDSREQPKEPKAQGEPAINGTVLAKISYGENGEARATLVSRILRDLRADMFGADVVAVQQALNDAGAALQVDGYFGAKTARALREFQRAQGLSVDGVFGPQSQNALGL

SEQ ID NO: 4748 - protein, 93 aa, Duganella sp.
  Derived Active Sequence
GDITLYTRAHFGGPALQLHGSEPDLDKLGFNDRTSSVIVQNGTWEVCENKHYKGKCLILEKGEYAELKNFNDMMSSVREIEARPAAKDKPEHK

SEQ ID NO: 4749 - protein, 495 aa, Serratia sp.
  Derived Active Sequence
GQLILKNTSLSPITCTVDGWTVSSGSSFDWFIKVQPGQSFFVGQNTSRPKDPVINWAKCNNLQTRAMTITPSGPNQTLVLNGQQTQVLNVSLYPFLPTLPTDNFENLVAYIVQTYQSQHPQVLLNAVLNPQVNIYSFTELPVLLGNDGFDVIELDVLYLGFLADNHLINPAQITGEAPWAVALAGATYQGQLWAIPSWLCMDFFYAFDQAIQQQKTLSKMLNYLNTRTSSVAKMAGSFNGSWAIPSDYINAYVQTYGYGALQQAMQMPPDNGVVHQLVSLSDTCSFNGVNKCTNNTYHNAPNGGAEQVFASGQASTDMGFSEQSFYVNLYSSAQKPLYVVPTPWGEHPQPLLFEDAFVSSAATCKPGSQCAANAQAFTTLMTGTAMKNYIVQSKDLPAGTPWRTLLVATQQFWQQSIIANNSYYQQLSPIFMTAKAFPNNFTPQSQVAMANGICNALKQQQPNFVCKSNNSTSLLAPSHGSSIINPGSTDSRRGL

SEQ ID NO: 4750 - protein, 684 aa, Paenibacillus sp.
  Derived Active Sequence
ESHVDNPYQGATKYISPDYAASVDTSIAKITDANLKAKMQTVKTFPTAVWLDRIAAINGGGGKLGLEAHLDQVLAQKKGSTPITAEFIVYDLPGRDCHALASNGELPLTQAGLETYKKDYIDKIAAIFANPKYKDIRIVAIIEPDSLPNLVTNLDDPKCAQAKSTGIYEAGVKYTMNKLNEIPNVYKYVDIGHSGWLGWDNNRSATVSLFTTIFKDTSKGLASVDGFITNTANTSPLTEPNLPDPNLNIGGQPIKSSKYYEWNPNFDESDFAEALHRDFVSAGWPSSLGMLIDTGRNGWGGPNRPTSAVGNDINSYVNSGRVDKRSHRGNWCNNSGAGMGTPPQTAPAGHIDAYVWAKPPGDSDGSSSLIPNDEGKGFDRMCDPTYTTKDGTLTDALPNAPISGAWFHDQFVMLVQNAYPAIVPSTGGVDPAPTAPAVPSGLKAVVGNAQVTLTWNASTGADSYTVKRATSEAGPFTAVAPLVTEREYTDKGLTNGTTYFYVVSATNAKGTSKDSAAVSAEPKGTPTDPTDPTDPTDPTEPAGDLVVMYRAGDTDPANNAVKPFFNLKNKGTTPVKLSELKIRYYFTKDGSQELQSAVDYAQVGNDNVLRTFTDNYIEIGFSPAAGTLAAGAQTGDIQIRMNNSDWSNLDESNDYSFDPTKTSYAEWNKATLFHNDKLVWGIEP

SEQ ID NO: 4751 - protein, 398 aa, Bacillus sp.
  Derived Active Sequence
YIHIPKQIVLFEQQKEKINTTLPLSVEASSPVYDVTSNKAKLTVAGKQVGKEELMLHLAGIPVKRVDVQVLSDFKVIPGGQSIGVKLNSKGVLVVGYHQVDTAKGKKSPGEIAGIQVGDMITKINGKTIEKMSDITPFIQQAGKTGEPLNLHILREKKQFDTKLYPLKDKQDYAYRIGLYIRDSAAGIGTMTFYDPKSKKYGALGHVISDMDTKKPIVVEDGQIVRSTVTSIEKGSNGVPGEKLARFSEDRQIIGNITRNSPFGIFGKLSSTMENGIMDKAMPIALSHQVKEGPAKILTVVDDDQVEEFDIEIMSTIPQKFPATKGMVIKITDPKLLKKTGGIVQGMSGSPIIQNGKVVGAVTHVFVNDPTSGYGVHIEWMLNEAGIDIYKNNRKKAS

SEQ ID NO: 4752 - protein, 266 aa, Bacillus sp.
  Derived Active Sequence
VGSYIQNGRIDLMALLVFSLVVGFVGSFISLGMSRWMAKTMMGVRVLNPKKQSLSYEEQQLVDRVHRLSRAAGMTKMPEVGIYHSPEVNAFATGPSKRRSLVAVSSGLLQQMDDAAVEGVLAHEVAHITNGDMVTMTLLQGIVNTFVVFLSRIAAWVASRFVKEDLAPVVHFIAMIVFQIIFSILGSLVVFAYSRHREFHADRGGADLAGKDKMIHALRTLKSYSGHVNEEDQTAVQTLKINGKKHSSLFSTHPDLDERIRRLEAK

SEQ ID NO: 4753 - protein, 735 aa, Ammonifex sp.
  Derived Active Sequence
ACTYSMTYIQKVKAGGTYDIGTLVVTVDPVSAEASVGRYVVLSLPGSPSGYELFPGLSENEIAAKITGTNYFNTANGATFKVERLSAREVRLWVGSIATAGIAPGDDSRILIPLRITVPSGVSGDIILTVSAPSTSAFLNGSLVIARADANLPDWVFAVYMAADNDLSRFALADLREMLSVPGLGGNVVVVLLDLPGSENDGVYLVQRGTLQPVPGWPQGQELNTGDPSLLAAFLDFVRNKFPAGRYALILWDHGAGWRKLQPRGVCFDDLSRDFLMVPELRQALVRARVPLDLVGFDACFMGMVEVAYELEGLASVMVASEEGEPGDGWPYDKILTWLVANASTADGKALGRAIVSAYTQAYQGYGALTMSAIDLGCIKDVREKTDSLAVALLRNFDSDKTQISQAVQNARSYHREEFRDLYDYASLLTSYCSSSVEIRAAAQDLQKSIERAVLANGTTQYDDRSRGLSIWLPPESQAYLELLSYYGVDFASMFNWYSNLRFAKESRWGHFIKKWILDESTPIATAFGVESTDPADGATDVPVDKTITLTYNTPVRPGPAYGKIALLDASGRKVSIRKKLAGTVFTIDPVKNLSYGTTYTLVLPAGAVKDGAGNLSEEFVLSFTTEPPDVTPPAVVETDPPAGGVVDSLKPVLKVRFSEQVYTGRNYSRIAIYDESGRRVAVSKRISGDLLEVRPVGALKPGMAYRLYLPAGAVKDKAGNLSEEFELVFVAPGP

SEQ ID NO: 4754 - protein, 186 aa, Collimonas sp.
  Derived Active Sequence
HGYVDAPKSRAFMCKAQENTACGAIQYEPQSVEGAKGFPDAGPADGAIAAGGLAQFAELNEQTPTRWKKVALTTGANDFNWYFTAGHMTQDWRYYITKQGWNPSQKLSREAFDLQPFCVIKGGFAPGSNTHAKHRCNIPADRSGYHVILSTWNIADTGNAFYQVIDAQIQAGATMNPQKVIINPFK

SEQ ID NO: 4755 - protein, 183 aa, Salinibacillus sp.
  Derived Active Sequence
SLLNTKKTKHEEAKLLTHINHDTDTSFSSLSADEDKKKIKPIRLSANTEKKENEQSEKTNEKKETYSESEKELLSRLVHAEAKGESYEGKVAVASVVLNRTDKNGFPDTIRGVIYQKNAFEPVANGSINQEPDKESIEAVEEAMSSKDRETEALFFYNPKTASDDWIRSRKIIEKIGRHVFAI

SEQ ID NO: 4756 - protein, 317 aa, Paenibacillus sp.
  Derived Active Sequence
APAFAKGADISWVAGMEAQGMTWKDKKGVRRDILQILRDDYQINSVRIRVWVNPDMKDYASGYMNAEKAAELAQRAKKLGMSVMLTLHYSDSWADPGQQNKPYAWRNFTFTQLMDAVWSHTVYVMNTMKSKGVTPDWVQIGNETNNGMLWEDGKASVNMKNYAWLVNTGNNAVKSVSSSTKTIVHLANGDNGSVLNWNIGGLIDNGAQFDLIGLSLYPSPSDWQGKVDQTITNANNLIAKYGKGIVISEIGMEYNEPAASKAFISAIKTKVRNIGGGKGTGVFYWEPAATPGYNQGYNKGAWQADGKPTSALEGFIN

SEQ ID NO: 4757 - protein, 84 aa, Amycolatopsis sp.
  Derived Active Sequence
IDHIPCRAGENFLKIWSHLDGRDSVDCYANRGRIGFGGWWVDKIETGNNDLIYSDANGDSVRVNRWTIITYPNRPPRVNYIEIL

SEQ ID NO: 4758 - protein, 322 aa, Paenibacillus sp.
  Derived Active Sequence
GIGVGYRDPAHPKKGAAVIVYTDRLASASTGLLSATALGKKTNVPVRIVKTGKIRANATDYKVRIRPVIAGYSVGTIEGSGSTGLIVAPTGAPATRYLFSNNHVLNPSNTDNREATIQPGGADGGTVTQDRMGRLYRYVRLNPTGINLIDAALSLPTRNNLLNPRYATVGAIPGHVTAYRIGERLKKVGRTTGRVNGTVESVYTDLQINYGGELGLLTFEDQTVIRGTTPVSLPGDSGSVWLRQSDNYAAAVNYAGTADGRLSIAFPVQWAMQVFNTRVARPNGAGRVLRVDTGSSPRSYTRQLTSEELVRLRPRTTRIRRS

SEQ ID NO: 4759 - protein, 260 aa, Pantoea sp.
  Derived Active Sequence
ATAIPDGSAQAVTGAAAPTAAPVLLAADEFDGPAGSAPNPVIWRYDLGASGWGNAELQTYTDSRRNAALDGAGNLVITAHREADGSYSSARLKSESTYTAQYGRIEARIRIPRGQGIWPAFWMLGADIGQVGWPACGEIDVMENVGYEPGIVHGTVHGPGYSGAQGISAAYTNPSGAAFADDFHVYGVDWRPGSITWTVDGVAYRTVTRADVGSATWVFDKPFFVILNVAVGGNWPGSPDASTRFPQQMTIDWLRVHQNA

SEQ ID NO: 4760 - protein, 455 aa, Pseudomonas sp.
  Derived Active Sequence
SSHVPQPEATHVPNIAARAKQKPIWLSEKPTPQVPQDVWERMRQGFQLQDNLGVNPRIEQQRLWFASNPSFLENAGERGSLYIHYIIERLEERNMPLELALLPVIESAYNPMAYSRADAVGLWQFIPSTGRYYNLRQTRFYDGRRDITASTTAAMDYLTRLHDMFNGDWLLALAAYNAGEGTVSRAIERNEKLGLPTDYWNLPLPAETQAYVPKLLALSQVVLAPEAYGVNLNPIANEPYFQVVEINQRMDLSKVAAVANIDEDELFQLNPAFKQRTTIDGPQHLLVPTSKAQLLTASLSTMRPEELISSRPLKPVFEGADDNEIAKLKRAYRVKRGDNLAAIAKANKVDVKDLQRWNKMTGKNLKVGQTLVMQDNTKRSAGRINTVVAASGKSKGKDTGKTVAKTQQTYKVQQGDSLYMVAKRFNVEMQHLKRWNPRVGQALKPGQMLTVSSPR

SEQ ID NO: 4761 - protein, 615 aa, Salinibacillus sp.
  Derived Active Sequence
KPRSSDDAKQIVDRMTLDEKIGQMLMPDFRNWKKEGESSPQAFTKMNEEVAGLIKKYQFGGVILFAENVKTTEQTVRLTDAYQKASPKIPLLLSIDQEGGIVTRLGEGTNFPGNMALGATRSRINAYQTGSMIGKELSVLGINTDFSPVLDINNNPDNPVIGVRSFSSDRELTARLGLYSMKGLQRQNIASALKHFPGHGDTDVDSHYGLPLVSHNQERLREVELYPFQKAIDAGADMVMTAHVQFPAFDDTTYKSKLDGSDIMVPATLSKKVMTGLLREEMGFGGVIVTDALNMKAIADHFGQEEAVVMAIKAGVDIALMPASVTSLKDEQKLASVIDSLKEAVKNGDIPLQQINKSVERIISLKIKRGIYSAQHDSSIDKKVKKALKTVGSKHHTKTEQKIAEKAVTVLKNDQHTLPFKPKKGSRILIAAPYEEQTASIEKTIHDLMQRKKIKSVSLNKMNFAEKVFNAEHEKQVKEADYIITGSYVVKNDPVVNDGVIDDTVTDSSKWATAFPRAVMNAALQHKKQFVLMSLRNPYDAANFEEARALIAVYGFKGYANGRYLQPNIPAGVKAIFGQSKPKGTLPVDIPSVTKPGDILYPFGYGVNIKTGKPL

SEQ ID NO: 4762 - protein, 78 aa, Streptosporangium sp.
  Derived Active Sequence
SQYVAYEGPGFTGRSVVIDRCGPSNIPFHGSYKWYGDGQSGRMYNQPNTQGVTHFELPSNRNAEQRTPVGWKSIFIVC

SEQ ID NO: 4763 - protein, 222 aa, Burkholderia sp.
  Derived Active Sequence
LTAGVQEACAHGAIGTPIARQYQCRLEGGYWDPADGSGIPHTDCRAAYQNGGNSAYPFTQWNEFSANPIGQGDDLEKLQQAVPDGLLCAGGDKKKSGIDVPAVAWRKTRVTPVGGKIDVTWENTQSHTPSVMRIYLSKPGYNPQQPLRWADLDKIYDAPAPAPQPADGGGRLPGTVTSFYKLSVPLPAGRTGDAVLYSYWQRRDAGNEGFFNCSDITILPGR

SEQ ID NO: 4764 - protein, 853 aa, Salinibacillus sp.
  Derived Active Sequence
AAYTDYSIYKVEPAKTFSTESQASQAAAKLEKDTGWDASYQASGTTATYQITATGIHSEAQAKTVLSGLTKQTAITGTSSPVGSKQPYMTITSGAISSEKQANTLLAKLKQETGVSGAVKMSGTAQFYMNVVTSEIAEETKVKELIQGLTKKTGIKSTYQPVTHEVSVTSIQSGAITGDSKAAQVKNAFQKESGLKASLKETAKGQAYYTFTTASISGEANAKTLLQQLKQSTGITGSYKSINQKTTADVYNVQSAYFKGLNTVKDAISQIKKNTGVSGYYQKVGKSTSYTVNMKNLTKQQLQKVDAFFKKKKWHYTSSAVKKTATSSAYQITTAQILGEQQANKAAAFFTQKKVKATKKATGKKAENQYQLISEETTDQAKVTKGLNVLKKNKLSAAAKTVKKQTANTFKITTESLLEAAKVNEAITFFKSNQISAASKKTGQTAESKYQITTEAIISQEDIDRVLAFFKKNNASGTAVKTGATAYTQYKILTSQLSSKTALNNGLNYFKALQLSANYTTKSNTLYKISLNEQFTGNSAASAASAKLKQLYGWTSSTVKIKNGPQIMKTNYNLSLRDMVQKQMKVSPQTDGAAYVSLTYINTATSTVTADVLNIRSTPAVSPTNVIGQLKKGDKVKIIGQTNGWAKINMGWRNASSDEVGQYVDPNNFSKDSKYYFQFLKLSQTAGLSVAEVNQKVLAGKGILTGKAKAFIDAATKYSINELYLISHALLETGNGTSDLANGLTYNGRTVYNMYGIGAYDSNPNYYGAKYAYEQGWFTPEAAIIGGAKFIGSSYIHNTAYNQDTLYKMRWSATAAHQYATDIGWAYKQVNRMYSLYSLLDGYTLYYDVPEYQ

SEQ ID NO: 4765 - protein, 504 aa, Paenibacillus sp.
  Derived Active Sequence
EQELNKHKPPVSTGSGVFYEIYINSFYDSNGDGHGDLKGITQKLDYLNDGKPHSGKDLQVSGLWLMPLNPSPSYHKYDVTDYYQVDPQYGSLNDFRTLMKEADRKGVKVIMDLVINHSSSEHPWFKEASANPQSKYHNYYVWADENTDLEEKGSWGQQVWHKNPNGEGYFYCTFWSGMPDLNFDNPEVRKEMIKVGKYWLQQGADGFRLDAAMHIFRGQTKDGADKNIAWWNEFRSEMEKVNPNVYLAGEVWDKPETIAPYFGPLHSLFNFDLGGTILNSVKNGRDQGIATFAEKTLQLYKSYNKAALDAPFLSNHDQTRVMSELGGDVRKAKLAASILLTLPGQPFLYYGEEIGMKGEKPDEYLREPMRWYKGDGPGQTTWEKPKYNTGEVSVEAQLRDDDSLLESYRTLIRLREEHEALRSDSLQPIQAGSASVTAFKRTSGKETMYVYHNLSGESVTLQIKDFDKGKWKVIFSTSKDVKVKKGTVTIPAYSSLITEEDRKS

SEQ ID NO: 4766 - protein, 466 aa, Collimonas sp.
  Derived Active Sequence
ATAGYSGYTGAASIVNGVPGKVATASLGAVVDATVLDQVVVATEAGARVTVPVSTTAAVAAEGIAGAGLKLVPYLGAALTAAQVASMLKNAGLRYGSCSAQSWFGLPAYCQQPPAADQYLWHGGFGSNSSVPYPDPTSACQGDMAALIRSNSTWAGWTMTLGSSSGPDVVGCVLVSPTGVVGSSNFTVASRYLNPNPGQLPPLAPATGDDIAGALKLQAIQDSNARKALYDAIKSDLAAHPEYQTADTNPVQPSTPASVTASPVISPTVTTRVDTVPKSDGSTDTVTTSQSTTVNPTTTGTTVGDIKTTFPSTTTTTVTTTNNVTNQTTTNTSVTSNPAPSPELKIPDDYNKEVTQKQVEKDLNTDAAPPMDDQQKVITDANTKGDTDRDKIYDDIKSGQQDKSSWFSWVWSPPVGVCAPITGVIAGFHVSWDLCPSIAIIQAIIGWLMGIFSAAEVYGQLFKRED

SEQ ID NO: 4767 - protein, 322 aa, Pseudomonas sp.
  Derived Active Sequence
QVPLREGYPQRYTVVAGDTLWSIANRFLRDPWQWPALWQANSSLADPDLIYPGDSLALVQVNGEPRLTLERGASRGTVKLSPQVRRTPLAEAIPTIPLQAIDSFLLSNRILDRAETFDSAPYIVAGDAERVLSGTGDRIFARGRFDPEQSAYGIFRQGKTYTDPQSGELLGINADEIGGGEVVAVEGDIATLQLQRTTQEVRLGDRLFSGEPRVINSTFVPSPPSRAVEGLIIDVPRGVTQIGALDVVTLNKGRRDGLAEGNVLAVLKTGETVRDRVAGGQVKMPDEGAGLLMVFRTYDKLSYGLVLNASRSLAIMDKVRNP

SEQ ID NO: 4768 - protein, 101 aa, Pantoea sp.
  Derived Active Sequence
QAPTPDQARQQQPVFQGQSTRTVPQLSDCIYRGWSTTSVIARDNTTHTQPDGSEISVFTWEDSIFADVSPRRKGSDVKYFTTFRMAPQVMADRQAIVERCL

SEQ ID NO: 4769 - protein, 357 aa, Paenibacillus sp.
  Derived Active Sequence
ALPPQASLDLFGSKSMRTTQESVVPDLKVYPGGQTIGVKVKSSGVLVVGHHIIQESNDRKVSPGETAGIRLGDRITHMNGKPLNSLARVAEAVDEAGKNKKPLDITLCRGEQTISTKLTPAYDQDDKAWRLGLYIRDSAAGVGTLTFYAPDQGVYGALGHVITDMNTQTPIVVGSGEIVQSNVTSIAKSQSGEPGEKRAHFLKDHRVLGNIERNTNFGIFGKMSDEPQYGLYSTPIPVALANEVKEGPAEILTVLEGQQIQRFQAEIVHISQQDKPATKGLVIRIVDPKLLDKTGGIVQGMSGSPIIQNGKLIGAVTHVFVNDPKSGYGCFIEWMLRDAGIMQNNVSLKSSSNLKAS

SEQ ID NO: 4770 - protein, 301 aa, Salinibacillus sp.
  Derived Active Sequence
AQTDLTSLTDESQEVTLENGSLSSKIAVLEVSGTIQDNGDSSSLLGSDGYNHRTFLKNLEQAKEDDAVKGIVLKVNSPGGGVYESAEIHKKLEEVKKETKKPIYVSMGSMAASGGYYISTAADKIFATPETLTGSLGVIMESVNYSKLADKLGISFETIKSGAHKDIMSPSREMTKEEKNIMQSMVDNSYEGFVDVISEGRGISKAEVKKIADGRVYDGRQAKKLNLVDELGFYDDTIAAMKKDHKNLKNASVVSYEESFGLGSLFTMGANKMFKSEIDFLNMREVLSQSGSPRMMYLYAK

SEQ ID NO: 4771 - protein, 87 aa, Amycolatopsis sp.
  Derived Active Sequence
IGEVACGNRDDFVKLDISFGNGMGTNKCFANAGVTGTNIGGVYNVFSGNNKVTVNYERNGRYETSTLGYWQGVGFSGTVRVYEVRIW

SEQ ID NO: 4772 - protein, 60 aa, Bradyrhizobium sp.
  Derived Active Sequence
QTTDKEKNGHHYSGGPKTEVPHHMGKKDTTGSSTKATSGGHHYTGGPNTSTPHHMGEKTK

SEQ ID NO: 4773 - protein, 166 aa, Pantoea sp.
  Derived Active Sequence
ATTSGTINATLTLTTGCLVNGQSATAGVNFGTLNFGSSAATFDTLNATLVGAAGNGIFVRCTTGQDYNVVVTSSNAAPATIYGTASASPRYLVLGSDNAQGIAYTLYSDASFTTAIANNTPIAASGTTDPTLGTNYAIYGRVVGGGFNPLIPAGTYTDTINVAVNY

SEQ ID NO: 4774 - protein, 73 aa, Bacillus sp.
  Derived Active Sequence
DKYSTVTITKGDTLWELSNKYHNHHHLTTNEFVKWVEDVNDLNSDTAQSLSPGDKLYIPVLKKELHNQVAIEQ

SEQ ID NO: 4775 - protein, 1548 aa, Variovorax sp.
  Derived Active Sequence
AITGVSPMTTLNNMATAAAEAVADPLPLQGPGLGNLTYTSAELFKPVSMITSLAHPLDPAHSSAYESREVPATYPGRKDYGMNAGIMVNGYFLTSFAPDSGLGPGGFLLYDVSNPRQIQLVKKIYEPEARTKEFRETHSFGTAKIGGKTYVVLPSIYGVEFWDFTDINDIKQVKKLALPGVNAGDYEDVSWQLWWQAPYLYVASAGRGIFIVDAGDPVNAVVANRGAGKPNPVPTGELGNFRIGPIFTMGNHMVLTAMESNGGFASLDISDPLNPKVLDSIVGTTPFYYATCFDGRNLHASTRGSGARMYSYDLSDRSRFVAEDNRLVIDEQLYCATQDNYVIQGAQTRIHKVDVSNPLNHVEVGRGSILREDDPNFSHSDNGQVAMFGNLVFVGNDHGSGSGFVVHAVDPDTTRPEVKQVSPANGAKQQALTSRIGLGMTDSIRPESVNANTFIVRAVGGNTLAGTYSVQLGIINFHPEQPLSPGTSYEVFLPANGVKDYAGNAIGADYKSTFNTGNATDINLMHYWTLAGNLSDQIGNNNGTPVSGDAFESIGMSFANRTAGVPLKNDSVATVLGGTASLSFYMKTTQAGGPNSWTAPGIFGRDQSGGADDVFWGWLDGNGRIKLSVGNDAGTTSTAVVNDGSWHHVVLTRDAASGAQAVYVDGVKTTSTGLTGNKGLSNKFQVLGQIQGNAALFKGTLAEVRVYGRVLTDSEVGTLRGQAIIGDPGIGGGPKIVNGQLVFDPATLGSSGAQFRWNFGDGTQTAYSTQPRYTYTYTRPGHYTVTLTVRDASGRETFYTYNLTVIVPVTARAPTHTTNIAGDANSVYSLNPDSGTVAAIDAQTLAKRWEVRVGDEPKTLAVGPDGRIWVTVQGEDKLVALSAADGSLSATVPLAYGSGPYGVAFTPDGAKGLLTLESKSVLMSFDPSNGTTTGAVALEGSLRGIAVSSDAQVAYVTRFKSRMTGGQLHKVNLQSMSAMPTIALPVDTTTVDTESRARGVANYLSQVVISPDGRRAVLPSKKDNIVRGRFRDGVDLTHDQSVRSILSQVDLQAAAEVFDEQIDFDDRAPARAALFSPPGDYLFVAQMEGNRVAIVDPYSRAVRGEINASSAPHGLYLDAARKRLFVNNFLARSVSVHDVASVLSSESAAAIFLQNVSTVAQEPMAAAALRGKQVFYNASDRRMSKDNYISCASCHADAGDDGMVWDFTQRGEGLRRTISLMGRRGAGHGKMHWTANFDEVQDFENDIRNEFGGTGFLTNADFAATADPLGAPKAGKSAQLDDLAAYLSSLNKYMRSPARAADGSLSVEAVRGQTVFNTAQCATCHTGGTFRDGLRHDVGTIQLSSGKGINQPLAGLGFDTPTLSGTWNTTAFFHNGQAATLQDVLNSGHGNASSLPAPDVVALREYVRSLDTAPAVVTRIRSDLNPTMCVNIKGGATASGTVAVQWPCGTASNEKFTVTSITGGYVQLVAEHSGLCLAQNGTATTNAPVVQLACTAGSTAQWSLVGGTLRNRGSGSCLDVPNGSTTQDTALITWTCNGGNNQNWTQLP

SEQ ID NO: 4776 - protein, 96 aa, Streptomyces sp.
  Derived Active Sequence
ASSDVSILINRTNCNQNDYFEIHNNNGRDTLCFANAGSMPVAIYGVNWIESGNNVVTFEFQRNLSEPRLETVTLDKWRSWQPGQPSIHRVTWIRIH

SEQ ID NO: 4777 - protein, 476 aa, Collimonas sp.
  Derived Active Sequence
SDGGSSGVSSASLQQVSAKASAPACAAAWVASAIYTGGNSASYSNVNYTANWWTQGNNPSTESGPIGSGKPWTSAGACGDAAPPVTPPPVTPPPGATTGTINFHLLLGAGSAQDQLLLDGGNYNDLIMSNIVAGVMYGHLLQQYYPGMQFQKDYLYGSILGQLLQENIATGLYVSSGNLIDPSPDQQAVMATGQGGPYQINNYAADMVSGSYAPAGHSLINYVAIQKNIGYTMANAAQQYSKPTPPSFNNKYYGPMLTAYFHYNDFVALIVTGKGMGGWTTPWQPDYDNALVKFTKLPNNFLDVLLNVAYNQGFYGTLMSSYSKLAATATASTVTSVNAYSSVWGATDTYKQYPYQVRYYLDQLYDNPIPTTSATTFVTPANHVAFGVAALETVFSNVFQTLAYVNGSGQSAYISAAQAQAAFNSALATAEVAAGATLDLSNAANRAQIFSVLEKAIGNLETSLNTKFNATTSVQL

SEQ ID NO: 4778 - protein, 187 aa, Bradyrhizobium sp.
  Derived Active Sequence
APLPTASLHVGTTYARWLWPVQAVRGQTNAASVSLQILPSQTVNVGGKVSFGVTARRTGYLILVDVDAEGRMSQIFPTPELLAQSNERDINLVKPGVEFVVPAPAARQRGFEYVVAPPAGSAVMIAILSERRVQLLDLPDMPRKLEGQADALSYLSAWTSELRVPDNSSGKLVTNNWSFDVKSYSIK

SEQ ID NO: 4779 - protein, 823 aa, Pantoea sp.
  Derived Active Sequence
GDILVQGSQLQAGGDLRLTAKNDISLLSAQNSERTDSTNSSKGGSLGIGLTAGSGGYGISVSASVNAGKGRENGNGLTHTETTLTAGNGLSLNAGRDTMLTGAQVRGDSVKVDTGRNLTLTSEQDSDRYDSKQQNASAGGSFTFGSMTGSASVNLSQDRMHSNWQSVAEQTGIFAGKGGFDVTAGEHTQLNGAVISSTATADKNRLDTGTLGFSNIENHADYKTEHQSVGMSPAGSTGSQFEGNMANGLLAGLNGSGSASSVTKAAVSDGTLIIRDKAKQTQDVSALSRDAAGANPGLDKIFDKEKEQRRMETAQLLAEIGSQAGDIARTYGQIEATKAATEKMKTVTPDQKKDAEAQWRKANPGQEPTAADITGQVYQTLYNREMLAGGMGTGGSVQQGISAATAAIQGLAGGNIAQAMSGAAAPYLAEQIHKLTTTKGPDGKEVVNVQANLIAHAVVGAVTSYASGNPALAGASGAAMGEYIAQQMYPGVKREDLSEEQRQTISALGTLAAGLAGGVAGDSTGGAVAGAQAGKNAVENNALHAPDEKKRQDAKWSLPYLEGEKKQQAEQLISDLDAKDKAFDVALDSACKGLSSAACQGMRQELAAMGKSYSEQLDGQYIGNMGSVYKEGKGQVDALIWQYATADAKAERDANVNRIAENWGVSKETADGLYTTMAGVHTAAAIGGALWGLKGPGTVTVYRVEGTPNTRVVIGDNGQVSITGNTTLYLNFGDKARALEFFEKRGSQNMDGAAIKTFEVPHSVLDDLRNTVVKESVARLPENKGKPVIADPTKAKDQYGIRPEKLEELKDKIIQGTGRNASK

SEQ ID NO: 4780 - protein, 217 aa, Pantoea sp.
  Derived Active Sequence
YQAYTLSDDQVKQLSDKSCEQMDKDNQIAPANSDYQQRLNKIAAALGDNINGVPANYKVYQTKDVNAWAMANGCIRVYSGLMDMMTDNEVEGVLGHEMGHVALGHTRKAMQLAYATTAARTAAASVGGVIGSLSQSQLGEMGEKLVNAQFSQTQESQADDYSYDLMKKRNIDPMGLATSFEKLAKMEQGRQSSMFDSHPASEARAAHIRERIAADSK

SEQ ID NO: 4781 - protein, 813 aa, Burkholderia sp.
  Derived Active Sequence
QSAQTFNAPMPGAPATPDAQARPPGGILSPFLLSAQLGRDLMLHYAIDNNNANAAGVPCADLGADSASCATGRLILENRGQARISGDGWKLYLHSIRRLLRIDHPGFTLRHLTGDLYELTPKPGALTLAPGARLTVPFVAEYWFLRYSDLLPRPYVIVPGALPTVLRHNDTDDETRYVDSLPADAQSSSTGNAPPAAVQPVASRALPSVKRERLGNDTVELRGVQLALTGLAANHVAALRERAGELGLGGSGLPVRGSIVPQQLPADIAIPGGYRLSITRQGANIEAYDQTGLYYGVQTLFSLTPAGGGRIPAMQVEDAPRFPHRGMHADLARNFKHADTLRKLIDQMSAYKLNRLHLHLSDDEGWRIEIPGLPELTAVGSRRCHDPSETLCLLPQLGSGPDNRSGGGYLRRDEYVSLLRYAAERFVDVIPEIDMPAHARAAVQSMEVRYRLFHALGREREASEYRLIDPQDTSNTLSVQFYDRRSYLNPCAPGSLKFATKVIREIAAMYADAQAPLPIWHFGGDEAKNILLGAGFQPLNGTDPNKGRVDQAAQDLPWARSPMCTALLQRGEIKSTEELPTRFAQQVSAQVAANGIGTMAAWQDGLKHANGPQDFSTRNTMVTLWDTLFWGAADSARDWSAKGYRTVLALPDYLYFDFPYTTNPRERGYYWGSHATDEYKVFSFAPENLPQNAEVIGDRDGNPFEVTGTGAAPRLEGMQGQAWGEVMRNDGEFEYMVYPRLLALAERAWHRADWERPYAAGVRYKLGDTHLVDKDALNKDWAGFATVLEQRELPKLGRAGIGYRPPTFSLSGS

SEQ ID NO: 4782 - protein, 269 aa, Janthinobacterium sp.
  Derived Active Sequence
GEIRLYTDDNFKGRVVVLRDTTDDLSRVNFNDTVSSIQVDSGSWEVCTHADFKGDCKTLERGDYRSMPGMNDKISSVRETGAGQGSGSGSGGGRRAALELFADGGQRGASAGVNSDRDDLVDISFNDRASSARVEYGYWQLCSDSNYRGSCRVFGPGSHDDLGSLNGRVSSARLVDPREENRPQNDEGLVVLYGRAFLKGPGLQVNRDVSDLVRLNFNDQAASLAINEGTWEVCTDSQFNGSCERMGPGKYEVLNTTLDKRISSLRRLY

SEQ ID NO: 4783 - protein, 195 aa, Pantoea sp.
  Derived Active Sequence
GHTEYSRTAMQHVDMSVTGIPTILGLGTLGTSIPLTPEYSLTAAHVAKTAVQRVKSYHPYCDLAIIYHKNDASTLTKFRNSDIGDPVKMYGYSFISAMPVESTGVNLARTAIRNNWNKSPCIAMASNAGVVQGMSGGGVYNRDDTLGGVIVGYSDSIKNGRNNKVILKDVSLYIPYGQFKSWLESNLAQTPTRGA

SEQ ID NO: 4784 - protein, 167 aa, Bacillus sp.
  Derived Active Sequence
AETTHRVKAGETLYKIGAEYGVTVQQLKEANHKSTDSINANETLTIPNSISESDKELLARLVQAEAKGEPYAGKVAVATVVLNRVDSDSFPNSIHDVIYQGTQFTPVQNGEINKAADAEAKKAVNEALAFRGQGKGSLFFFNPDKTSDQWLRQKQVTITIGNHVFAK

SEQ ID NO: 4785 - protein, 336 aa, Salinibacillus sp.
  Derived Active Sequence
HTVSPVNPKAQQTTKDVMNWLAHLPNRSENRVLSGAFGGYSHDTFSMAEAERIRSSAGQSPAIYGCDYARGWLETSNIEDSIDVSCNSDLISYWKSGGIPQISLHLANPAYQSGHYKTPITNDQYKKLLDSSTTEGKRLNAMLSKIADGLQELENQGVPVLFRPLHEMNGEWFWWGLTSYNQKDDERIYLYKQLYIKIYHYMTGERGLDHLLWVYSPDANRDFKTDFYPGASYVDIVGLDAYFQDPYSISGYDQLTALNKPFAFTEVGPQTANGNFDYSLFMSAIKQKYPKTTYFLAWNDEWSPAVNKGASSLYNDNWTLNKGEVWNGNTLTPIVE

SEQ ID NO: 4786 - protein, 334 aa, Paenibacillus sp.
  Derived Active Sequence
KKLEPKEAVTTGTANAMKLNSYESKSQFTIKELTITSASVPSEQSAMVTSMLKNADITLDGVYQKEPFQSEMTLGIHLKGDLSTSFTIPMVMTKDKLYVKIPNIPFYPLPQDVVGKFLIIDPQELAKQSGQEFNPAAMDQEKSQKFANEVIAAIMNEYDQATYFFDIDPKDAKLPQGVEAKQVVQFKITNDNVKQATNTFITKALPKVLDVMSKDEYAGMLQVKKEELAEAKKELQSNTSEVSKKLDELKNYLTVKQFDINTALNKDNIPVYQDLNANVEMNDPATKDNVKLSVTGYTQYSKINAKAAFKVGIPTGDQVLTMEQLQQKMQTVAP

SEQ ID NO: 4787 - protein, 114 aa, Bacillus sp.
  Derived Active Sequence
EQPKVEVFQIETGKVVRSTPKPPSVQKEAEKSITSITGLYKKASPLPKKGYLVKVPLDPAVKIENSAVNTLASEVIFVLEPNQKPIMMVFDNENRTYFFEFTHDLTLLRKALQL

SEQ ID NO: 4788 - protein, 230 aa, Arthrobacter sp.
  Derived Active Sequence
ENRETGTAPATQPPSASAPPANPSAKPTTTETLPPPTTAPAEPLPSAVPPSSSDPAPAADPVTFTFADGRLSFTHPAGWRVEHSQTVASPSVQNATVYDTSGNEQIGIFYSEVGGGVAGPHTRTVFFSEPVPGLQGHSGPASGPATAHVSFYVDHIYGEPHYSLSLTHREALSPDGTEGADVVIVGGNRVLAANVVFTGGPFASDEAAKAWFAGTEGQALKAILMSFSYR

SEQ ID NO: 4789 - protein, 860 aa, Serratia sp.
  Derived Active Sequence
NQQVVDQLSQLQVNLKMLDNRAAENGVDCAKLGADWASCHKVLITLTNGNQEIKDKDWAIYFHSPRQTLKVDNDQFKITHITGDLYKLEPTDKFTSFPANQAVEIPIIAEYWQLFRTDFLPRWYATSGDAQPKILSNTDTEDVNQFVAPFTGDQWKRTKDDNNILMVPESRFTKNQDLKVLPMASLRGQIIPTPMEVKVHAKDIDLSKGVALELSALTKPAADAAAERFALLGIESQANGYPIKTDIKPAAFKGDQAVPGAYQLKIGEKGAEIVGFDQTGVFYGLQSILSLIPSDGSKKIATLDAKDAPRFQYRGIFLDVARNFHQKDAVLRLLDQMAAYKLNKFHFHLTDDEGWRIEIPGLPELTEVGGQRCHDLSETTCLMPQYGSGPAPHGGFFSRQDYIDIVKYAQARQIEVIPEIDMPAHARAAITSMEARYKKLLAEGKEKEANEFRLVDPTDTSNTTSVQYFNRQSYLNPCLDSSKNFVDKVIGEVAQMHKEAGQPLKTWHFGGDEAKNIRLGAGYTDVKNPEAGKGILDLSKEDKPWAKSQVCQAIIKDGKVEDMEHLPSYFGLEVSQLVKAHGIDRMQAWQDGLKDAKDSKAFATKHVAVNFWDTLYWGGFDSANDWANKGYDVVISNPDYVYMDFPYEVSPDEHGYYWGTRFSDEQKIFSFAPNNLPQNAETSVDRDGNHFTAKSDKPWPGAYGLSAQLWSEVVRTDQQMEYMIYPRAVSLAERAWHRASWEQDYKAGREYKGGETHQVDTKTLDQDWLRFANLIGQRELAKMDKAGVSYRLPVPGARIIGGKLEANIALPGLGIEYSTDGGKQWQRYDDKARPSVAGDVQIRAISPDGKRFSRAEPVKA

SEQ ID NO: 4790 - protein, 632 aa, Collimonas sp.
  Derived Active Sequence
FVFIPAAGAGQPLATTYPNGEIYNYPIRSIISFASSVDVIGSKLAQSLSSSVFQGESLDEKTLGSSFGGRHNTTLTYLDGATILSNVNSLKRSKILLDAGVPLLIRVDRNQLEVGKQVAALFGVSIRSGYMLLSKDGPAKLTVFNLQAPDNTAIPNGLMQALGAVKQKNVLPSLRANIRALETDQVGIPKVTLNLNSADVTGQIVSIVNLDLIRSASRGNDKKFIVVKATPTVRSTRNGVVIGSAPNNNLWGAYLPHQYSISHEVSGTALTPILVSSDPPSDSRTEFTYTETKTHGFTIGGSFGAEGGGEHTDKWKYIAKTPFNINAGISYTNTKTLTNIFKDYSLLAAPAIGKIKWDLFIDPKLKFVLVERETAGLPTLNENRMTPMMRSASMETYSTWELPGNYEGLATLKIGGGYILDRREWWYDRSDVKRRYETDTFETLDDIILDFGSPYLTREMTVLIRSADGHGKCVGDQSGQAKLLSCSPADKSQLWGLDSESRYVNRLSGKCLTADVQSGELKTAACGIDNAQQWDWRADRIHSRYDRNWRLYSTADMLKVIPDSSMLFEDIPLNSFNRLNIPWASYPGAPSANDVMPNLNGPSPQISPDWIGKYHAADARQRWNIEILRDGI

SEQ ID NO: 4791 - protein, 739 aa, Streptomyces sp.
  Derived Active Sequence
ATYGTVREAFNNTAISPDGEPKAADFDAAGRSLSATDLDKAGWRRGTRVTVGATTYTRADVAPGQPDNVLATGQTLAIQGAGNALGFLASATSGPVAAPVTVTYTDGTSAQQTLEVPDWSAGTTTTAALSLAHHNTPSGQQTSPARLHAVTVPLDPRKTVTSVTLPKTGSSAAPGAPGLHVFDLSVRSTPSAPGGKFWAGSWGASFGSAQPVAQPGWAQQTLRMVVNPHTSGGTARIRFANTFSPQPIRLGHVTVAAQAGGATAAQAPVSLTFGGAAETTLPAGGEIYSDPVTFPVTAGKNLLVSIYLPDQVTTVPTHDYALTTSFISNRQSGDHTADTAATAFPGTLSHWTLVNGIDVAATENIGTVVTLGDSQTDGAHSTPDRNQRWPDHYAAALNATSRPTGVVNAGISANRLLTDRADIAGPSALSRLDRDVFAQSNVRTVVVYEGINDLAHDNASAQAVTEAIRRISARAKARGIRVVVATLPAFGGYSAYSDAKETARQQVNAAIRTMTEADAPTDFDLATRDPDMPSQLLPSMLKPGGGDHLHFGDAGTKALADTLVRAADGPSVTMSQTAAADFNGDGAQDLVAREDSTGILKMWLGRGNGTFASSTDVTAGWRAFSQTAAADFTGDGKADLIARDSSGTLKLWKGHGDGTFGSAITVTGGWEFTQTAAADFDGDGKADLIARDSSANLKIFTGDGKADLIARDDNTADLRSWAGHNDATFARPTTVTGGW

SEQ ID NO: 4792 - protein, 394 aa, Streptomyces sp.
  Derived Active Sequence
AEVCTGTASVYGILGDGRLTYSAINTKGDRLKTLIGPDLGFTPKAMATLNFNTILVTSTAGALYRVDVLTNNNALELSGVEKIADSGWTHDKLAYDGYGHLYGTTAAGNLLQYLVSQDKPQGSQHIGQRKEIGTGFVLKTLTATGKDRLLATAADGRLLSYKIIGSAWKRDDLKNDGWSAFDELTSSGGGFYFGRIPTTGAMYWYKDGNISDGSGSDIVYHTNDPVDTSGWTQKLLSAAPDTTSCKQVNTLGQDIAADANREVGNNFNDFDFNHARAWCAEFVEYIWAGNSVDHSRELDARAISLKEYGQRHGTYRTSGPKVGDAVLYDVDRNLNDGEADHVNIVVAVSADGTQIQTVGGNESGKVSKAGWFNWDTASSPVGAGPVLAFVSPKG

SEQ ID NO: 4793 - protein, 171 aa, Pseudogulbenkiania sp.
  Derived Active Sequence
IVDYGSGDDVPAADAALVLGAAAWGSKPSPVFRERINHAVKLYQSGKVRWIVFTGGTPEPGYPAEADVGREFAARQGVPMTAMLVENQSRTTWQNLSNARDLGNQFGIRSYLLVSDPLHMRRAVLMAGDLGLRAYPAPTLSSRFRTLASWSRFLARETWLYVGYRVFRQLS

SEQ ID NO: 4794 - protein, 398 aa, Collimonas sp.
  Derived Active Sequence
WEKYGIHSVYPAAISVQINPSQISNQQLAAIKDAGFEYVRFGTRPPVSDKPQDFSELLERLRKAQLKPIITLFGGATVWVQPKRMMSATMTPLDAADNFSKFALTTLNQYADPNILWELWNEPDNPTFLKPGMLQAGLVPAIQKICSALEQQKGGVKKNIFGFGFAKLPNLQPKIPDDKLLAISLQNCLSGVSVHPYRKIPETLADDATKSRELLHKYGKGELPMIASEWGYSNFTAARDQGGQAQLVLREYLSTVFAGIPLVNIYQWQDTGSDRAAREQNYGLTDSSGQVKQALPALKHLLGKLKDTQLAGSEKVGEAYQLVLNSQPGAAAKRSVHVVWSSAARSGPGGGFSIPRNKGQRCIISEFYPQQGDKPCPEGAGSVDINAGPSPLAVTLYD

SEQ ID NO: 4795 - protein, 98 aa, Pseudomonas sp.
  Derived Active Sequence
APQAHADSSPAPAMLLAQSLPGSSNNNPYNSPIRRANPNSMQGTQPSAPAVRGVNPVPVQRPPTLENGGIGNGYPRTITQPRIIDPTPVTPPRNQQQR

SEQ ID NO: 4796 - protein, 713 aa, Serratia sp.
  Derived Active Sequence
AETNPHASHSALPSGQAKEANVTGEANQHENKKNENPFFYQSRLPFQAPPFNLIKESDYAPAIDAGIKQKREEVEKIANNPAKPDFKNTFVALEQAGALLTRVMNVFGAMTSANTSDALQKLDEESSPKLAALEDAIMLNSKLFERIRAIYQQRDALKLDAESRRLVEVTYKNFELAGANLSDADKTRLKALNQEAATLSTQFSNKLLAATKDGALAIADKGKLDGLSESELAAAAQAAGERKLDKQWLLVLQNTTQQPELQSLKDRDTRKALFDASWNRAEKGDGNDTRQTIARLAKVRAEQAKLLGFPNYAAWKLQNQMAKTPDAALSFMRNIVPAATARAEREAKDIQAVIDQQKGDFKVAAWDWQFYAEQVRKAKYDLDESQIKPYFELDNVLNNGVFYAANLLYGISFKERKDIPVYQPDVRVYEVFDKDGKSLALFYTDFFKRDNKGGGAWMSNFVEQSKLKGTKPVIYNVANFTKPAPGQPALLSYDDVITLFHEFGHALHGMFADQEYPSLSGTNTARDFVEFPSQFNEHWASDPKVFAHFAKHYKTGEAMPQELVDKIKKADKFNKGYDMTELLSAALLDMHWHMLSADQPQQDVDKFEAESLLKDKIDLSYVPPRYRSSYFKHIWGNGYAAGYYAYLWTEMLADDAFQWFTEHGGLTAENGQRFRDMVLSRGNSQDLEKLYVDWRGKEPSIEPMLINRGLKDE

SEQ ID NO: 4797 - protein, 306 aa, Salinibacillus sp.
  Derived Active Sequence
GKELSDPVLSKRMELYHKVEAVTQIPWYALAAVDQYEENVRSNRKDLPDKTGIISIYVPDEIWSGPENPNPKDDAPLSIKVFDGIGMDGDGDGKAEVSNDEDILYTFAQYLLSYGTDEENIRIGLWNYYRRDQTVGIISEFMKLFKAYGHIDLGEHAFPLPIRTDYSYRSTWGDARGFGGRRIHEGTDLFAHYGLPVKSTCYGVIEMKGWNRFGGWRIGIRDINNTYHYFAHLNGFAKGIKTGQIVEPGQVIGSVGSSGYGPPGTAGKFPPHLHYGMYKDNGKTEWSFDPYPHLRAWERYEYKKKK

SEQ ID NO: 4798 - protein, 52 aa, Pseudomonas sp.
  Derived Active Sequence
EGGAERMKHYWDNFPISQQIPRTDSEQTSSESGKKPQAPVEDPSRTPAQPDA

SEQ ID NO: 4799 - protein, 233 aa, Bacillus sp.
  Derived Active Sequence
AKKSRFYYEKKGDIVWEVPMKDEKLIALTFDDGPDPKYTPTILNLLQKYGAKATFFVVGDRITSFPKLAQREVREGHELANHTYSHLKVRGQEVERIEQEIEKADERIQAITGIKPYLFRPPTGYYDDRVVKAAKNQQYTIILWSWHQDTFDWRNPGVGKIVSQVLNHARSGDIVLFHDTGGDRTQTIEALKQILPKLKEEGYKFVTVSELLKHHPNYKSLYLMQQQKQHSVQ
